United States Patent 7,468,248 (METHODS AND SYSTEMS FOR INFERRING BOVINE TRAITS) - sequence listing, part 23

SEQ ID NO: 64693 - DNA, 1017 bp, Bovine  19866880701217
gtgtattggagaagagagagaaacagatggtggaggtttaatactggcaatgtggtaagtattgctatgatggggataaagtcaagatgagaactctccaggaaatggcatcaaatccagtctgagaggaatgagaaaatcatcccagagaagatacactatgctgacacctgaagggtggatgagagatgattatgtaacaagggcatgagacagccagtcttccaaagcaaacaactcagcctaagttttcactcctgtaataagaaagtaaagatacaaatatttgtttgtgtagtttaaaagtcaaagactaagcataagaaaggtttagctgtcttcttatggagtcatttttctctaacactagacaagattaaaaatgttatggatgtggatatggagaagtagtggtgtgaatccaggcagctggagtctcagtctgagtaagcaccatttagaaagatcaccagtgtgccagctagaggcatgtaagcattttattatttgctttctagccaactaaagaagtatttgatgactgtaaactattcaactatggatctttctgtctggaaagaaacttgtctgagttctgatgtctccttttcatgtagagattattcctcaatgacccaggaggtatacatattcttctaatgtaaagggaggaattctagacttttatagaattggagataagatgaaaagaaggaatgtgttctgtacgaagagcatcaacaagaataagaacagactcatgtaaactggggacagtagaagaatgaaccagagcttttgatggaacttctaagaatctctcagaatgatagacttgcacttcgtgttggttacaaactttggttcagagatggagataatgcatatttagccatgacataatagatggtttacctggatcaaggttcctagatatcccaaactgataaaagggtgattcaagatttattctgtgctctgaactagacaaatgagcaagaaacagaacaggcatat

SEQ ID NO: 64694 - DNA, 1645 bp, Bovine  19866880795466
ttcatgtccaggtctaattattgcttcctgagctgcatacaggtttctcaagaggcaggtcaggtggtctggtaaaatcaactatactcaaaaaaataccaataattaaaaaaaaataaaatactcaagctaaatatttacaacaatttatgtaatccaaatgtattattataatatttcagtgtacctttgactgtgttgtacaacaatatcaatactgttaagtaaggaaatcagtcctgaatattcattggaaggactgatgctgaagctgaaactccaaaactttggccacctgatgcgaagaactgactccttgtaaaagaccctgatgttgggaaagtatgaaggttagaggagaaggggacagcagagggtgagatggttggatggcatcacccaacttaatggacacgagtttgagcaagctccgggagttggtgatggacaggggagcctggagtgttgcagtctatgggctttcaaagaatcggaaactactaagcaactgaactgaactgaagttataattcactggctcctgcagattatgggggtttcccaggtggtgctagtggtgaagaacccacatgccaatgcaagagactaagagatgcaggtttgatccctgggtcatgaagaccccctggagaagggtatggcaacccactccagttttcttgcctgtagaatcccatggacggaggagcctggtggaccacagtccatagtgtcccaaggaataagacatggctaaagcaacttagcacacactgcacatttactatctagttagacataacttctgaaacacttatgctaagtgctatgttaattctcaaaacttgaaaaatgtggagttagattcaagtgttaaaatctaaagccataaatttgctggcatttatctttaattgaataatttatcataatccatataaagcatagagcatataaaattttaacagatgctttagattgacaactttactactttcacatacttctgttgctggtctatgtccatatgcctattcaaaaaatacatatagttaactgcagtgtgatcctttcgtccaaaactaaataatttcaaattagccactctaaaaatgtaatagtatatgataatatcctcaagagtcaattttcaccattgtcatatctttcaatagttagttgttagaaggtttaactgtttctgtcagtgtttttaattagtcatatttattatatatagatttataatccatacagaatatagcaatagctactaaaatgacttcaccttttggttaatttaataacatgcatgttccagaaaaggttttaaaaacgtttgttcagagaatttggtcctttactttgctgtgttttcatcatggataaatgcaaaattggagaatatgaaacagactgctcaatcgatattttgtagacgtctgttgcataaatgttaaatctcttcttgtaggtgctaaaatgatgtaaagagatataaataaatgaataaattcattttcatgcatgcctacaactgtctccacacaactcattctactgcttcttttagtagttaatttactaatgaagtgtgaatctttgaaagctgtgttttttatattctgctaatgtagttttattc

SEQ ID NO: 64695 - DNA, 2762 bp, Bovine  19866880925092
aagacacatcccattttaaagatctctagagggtgactttgatccttgacttctggctttcaatctaccattttactaatattttcctgaagcaagtcaaatcataagttgaaaccttccaaatggattccacaaggctgagagttatctgcctttttttggccttctttttgcctcctttgacctgccctccttgaagcctgctggacacagatttaggaataacactttggtttgatattaggtcaaaagccagggcaaagtttgagcggaaaatagctgtcaaggcagaaggatggggcaaagcacaattgcacagacaggatcaaaggaaagccttgacccttaggcagcagtaaaggcagaagttgggccagaaattcttgctactgatggggattaattactagctcccaccaaattcaggatttgaagatgggactgtgagattcatatcactgatggtaacagtggcttctgacacaatctctgccaggtgacactatgcctctacaggcttatttttggataactacaagcttatggtaaggagcgccagacaactgatgtttcaaattacagagttagagaaactcttgagagtcctttggactgcaagaagatcaaatctttaatcctaaaggaaataaatcctgaatattcattggaaggactgatgctaaagctgaagctccaatactttgaccacctgataaaaagagcagacttactggtaaagatggtaaggctgggaaagattgaaggcaggagaagggaggtgacagaggatgagatgattggatggcattaccccctcaatggacatgagtttgagcaaactcccaagagatagtgaaggatagggaagcctggtgtgctgcagtccatggagatgcaaaagacttcaacttcacttagtgactgaacaaaacaacaagggtaaggagatgcttttacaaacaataatgataccacaataatttatacagtatgtttacatcatctcaggtcatctttatcctcacaagtccatgaagtacacagggcaagaatgattgtagatctcatttttcacttatggaatgtaagagtaggggaggtgaaaagatttggcgtgcatatttggttgctaaacggtaaagttcaggttcaaaatgttgtgtcttgaatcccaatggcattttcattccactataccatatcaatctaagtaattcagttctccaagtgaactgaaaggaaatggaaagctaaatgtaatatttcaaggagatatagaacagatccaaacatatgaatccagagatagagctcagattgtaaataaccagtcttgtcaagatatgaagccattccaaactctaaactgagatatgacttaaatgtcatatttgaataacagtcctgtgatccatcatctgtcataagttttaagatccaattttatagaaaatgaaaacaaacagattaatcctttttttcatgccaacatacaaaaactatgtaatatcctatgattctttgagaatcaggacctaaagtttccagtgaatatattttaaaacattttcgtttattggtgcctgacacttcagagcattacagagctatatctgtaattaaatattaatatgaaaataatatcaaaacaaatatttaaacctttatcttaaataaaaatatctaatgccatgctatttgtagaaatcttactacttgttaacttataaaaaataaattcttcaagaaattaaatacaggcactttttcctaatagctattctgtatttctgagaagcagtgcttgcatgcatttattctgacttcaaacactccaactaccactaggttgtcatcgaatttggttaactaattctatcagtaaaatagaacaaaataacattcatttataatttaaaggtctgagttgaagtggagatgaaaagacctcttgacatcttttccttttctccttttctattttaacatatttcttacactcatgagatgattgttctgttctcacactaaatctaataagtaatgaaatttccaatatcacatttgttatcaagtctttatttatttattttcctgaaagcctaactatgtcatatgttggttaatgtaatgatatttggctagaaatcaaaatatccaaagtccactcattcaaaattaaaattgggagggggataacaaaatctatacttaataaaatatacaactcagaaaaatctgagtcactaaagtctgcatataatttaataatagtaatagacatcatttctaacactaagattttgcttttactgatggctgcttagtatgactggtttagcatacagaaatatatgaatctcaatctctttcaatattgtatagatctggaaaaacattatactttatgattgtatagtactgtgcttgtatagttcatctttctgtcttcttcacatttctctcaatatctttgttaaaaattaaatatgtattgaaaattagaatatctttgttgttaagtctactggatagttgtatgttaagctggtgggtttgctaattcatatacaaacatggtatatctgtttcttcaataaatatgatatatgccaggtcagaagatacatattaacttttcctgagtacattttaaattcaactaaatagtcaggaattattccaaaagataaatacaaaaggactctgaaagctagaaagacaaatgtgcttgactagtgactttaaaagtcaaggagtaa

SEQ ID NO: 64696 - DNA, 1999 bp, Bovine  19866880963250
tttccttctccaggggatcttcccgacctaggaattgaacccaggtctcctgcattgcaggcagattctttactgactgagctataagggaagcccaggagattactaggggatctcaaaaagtcgaacacgactgagcaactgaacttaactgaggggattaaaaggattttctgtgtcctgcgttggctggtgtgcccagagcagagttcctggcaaagctttggaggatgggcgtgtaatagcattagtcaggttcttgtgaattctggaaaagaaagatgtagctctccacaccaggcttcacagatcatatttacttgctttcacttgtgtttattcaaaaagttttttaatacctaccagtgtgccagagactattagggcagggtctctatcctcaggaagcttactgtataataggaaacagctatcaacaatacaaaaataaaattaaaactgtgacaagcgctaaacattaggcatactaactagatactaaatttacagggttatttgaattactagaaggactgaaaagcaaggatgaataagttaccaaggaagggtaaagcattcctgcaggggggagccacatatgcaaaggtgtgtggcaagtgcaagggagtgaaagaagtccagtatgtctggtgttcagagagtagtgagagcttgatgtaagtcaggctgtcctaattgggggaagccaagacaagcaaaggacatcttttttgggtgttagttctaaaaggtcttgtaggtcttcatagaaccgttcaacttgagtttcttcagcgttactgattggggcatagacttggattactgtaatattgaatggtttgccttggaaacgaacagagatcattctgtcgtttttgagattgcgtccaaggactgcatttcggactcttgttgaccatgacggctactccatttcttctgagggattcctgcccgcagtagtagatataatggtcaactgagtttaattcacccattccagtccattttagttcgatgattcctagaatgtccacgttcagtcttgccatctcctgtttgaccactttcaatttgccttgattcatggacctaacattccaggttcctatgcaatactgctctttacagtattggaccttgcttctatcgccagtcacatccacaactgggtattgtttttgctttggctccatcccttcattctttctggaattgtttctccacagatctccaggggcatattgggcacctactgacctgggggagttcctctttcagtatcctatcattttgccttttcatactgttcatggggttataaattgttataactcttttcaaatgaacaattaaaatttcttttcaaatgaacaattaaaatttgttttttaaaacaatttttaaaaatcctttaaaaaatttcttccaacagttagttccatatgataaaatcaatttaagtgaaaaatttagaatgggtgagttagctaatggaccctttacagtaaagggtaaagggaatctatttaaaatatgtggaaaagaaatatcttttgcttctgtcctattcttattgtcagatcttgtatatttatttaaaaccttgattaaatactttttaaaatgtgcatcagagagtctcctcaacaacagatggtaatataatttatctaaacactgaagtagaaacaaaatcagttttatcagattttataaatttgatgaatttcagtaatccttatgctggcaaattatctcccagacttatctactactttgttattatcataaaatcattctactaaaactagcacatggaaaacatgtattgtagcaacagagaaacaagtcctttgtaaatatgaactcaagggagtagtcaatattcagcatgctttgtggtgtttaagttattaaaatagaggattttcagagaagcacagattacaggtgaggtaatagaggaagacataaataataaaaataaaataat

SEQ ID NO: 64697 - DNA, 1082 bp, Bovine  19866881171868
ctcccatcattgtcaacatagaaaatcaaacttggccattggtatcattttatgttttcctcccctttaagttagctacctctgtgaaaaagcatcatcactatgttttatggcatattcctctaacaaggtccattaaatgaatgccttattaactgaagaaatgggttgagctgtactaggttaatttatcttcaggaagtctgaaatttaacctataacagaaggcttgaaagaaaccagtgatgattggttcctgaaacagagcattagactatagaactaattctcttccaacatcacatcctgcctctctcctctcaacaaggtacatacaagatctagtctggacctctaactcttgattcagaattatgtattttctctgataagtccactgaaacagaggcagataattactgcataaggaaagccccctgctttgaaaaatctgtgggtgatcccagagtggaaaataaaggttccaaaacacagtcagagcctgtaggattttttttttttggctgcataataaaatctttctgtgatctgtctctctcagctcgaagcagtgatgccatcacctgagcaaaccaaaaaccagaataattttagctaagattttcactttagtatttctacatttttagcagggaaatagcaaggagatgtactcttgattaatctgaagttctttaaatacagcaggcatggatataaggaaatactttaataattagccaatacaattttatctttcacctgttacatgactgattttcctagtcccacatctgcgcgcaccacacacacacactcacatgcaaacgtgcatagggcataattttacctgctttttaagacatgaacgttaacacgaaataattgttatttccaaactcaaacaagtcaggctcaggaagttaagaaatgaatcagagttaacaaacaaaagggcatgtactaaataaagtgttttgctgagcacaggagcctacctaattccttttcatgcatcatttatagtgccctttaaaagaaaaaagtttcatcttaagctttaataagcatttatggaagca

SEQ ID NO: 64698 - DNA, 1540 bp, Bovine  19866881331906
atcaaaaatagaagcatattactgaatatttacagacatgaaggttactaatcctcaaccctcaaaatatagaacattttgttctctcatagaagttttgtctctgggtaaattggggcttagatacttttccatataagggctactattgtattttgtctttgacatgtattattttgatttcttaaaatcttaaatggttattttgttgcctagcgctctttggtgtcatcatgctaaagccaggcagctgtgatagtcacagccactatcacttgaagaacacagatgccacacacgtacacgcacgcacgcacacacacacacacacacacacacacacacacactggcagattattagtggcagtttctcccaactgtacccatgccctgggtttctgagcagactgctgtaatcatcctcttttaggagaggataagagattagtggtttacaactgttttagttcacattttagttttgaaaagtaaatgggtatctttagtggtttaaatgaatcgttaaacacacatttatgtattttatgaactaaataccttctaatccaaaatatttcttaattctaacagagaattacatattttgcacagatgtaaaataatttgagcagcttcagattattatatttttctcctaaggtcaataaaaagcttagtacttagccatagtcagctcaagtccactataatgacagtcccctagtaaccaaaataacacaaaataattacagattctagccaagacagtcttatttttaacctatgaatgtcaagacataaactggtttttagctctttggaaaccatgcctttacttttctgtttttggtagaagaatcactagaaaggcttttgctctctagagatcactgacttgcaatttatagtgatctatataattcttgggtagctcacctggtaaaaaaaaaattgctgcaatggggggtacctgggtttgagccctagtttgggatgatcccctggaagagggcatggcaacccactccagtattcttgcctagaaaatctcaattgacagaagagcctggtgggctccactccacagggttgcaatgagtcagacacatccgactaagtacacagataattttaaaagatcttgggccagaaaaaggtaaaagagttttgtaacaaaaatgtactgtgactttaccatacttgatcatctagaaaagatatgatatgatcaaaatatgttacatgtcttcaactaattgtggcaagtgtttttgcatttcatcaaaggacaataaaaacccttttctaaaacaatagtaaataaaattgcttttcctattcaggggtttaaggcataactaagtcttttaataacaagggttgtatggtatgctgaaacttccagatctataatatctatgcatttttactaatttttctacaatcatgttaaagaacatactggtatgtgggatgttcttcagtgtactgtgatggcatcagagtctgtttatgtgatatttcttttaaatatattt

SEQ ID NO: 64699 - DNA, 992 bp, Bovine  19866881390661
ttataaatgtggtaagtattatataaaccacaagttgtaacacaatgaattagagttaacttcgttgacctctagaagtttttatagcaggaagtgttcaatcttgacacatttgtggtggaaaaagtaaacagagtttcagacagtatattaggaggttgaatcaaaatgacattgattaatagtgtccccaagactttattaataatgtagcaattgcaggacatacctagctccctcagcatggaaagtagagttatatatgcacgaagggcaagagatgattaaacttgtcttgtcaggttaagtccagaaaaatattcccacctggtacagttcaaataatagactaaatttctgagactgagcaaaggaatgatacaggggtaaaagtaggggcattaagaacaatgtggatgtggatgatggagcttgttttgagtaaattcagtatcatgattttttttataagagatttaaatcatgagttctcagtagggaagaatgctattattaatgcaaagaagtattgtgtttgttgttttaaattgttatccggtaaaaataaaaagtgttagaagtgcaacagtagcatattatattaaacacacacacagagatataaaccaacttaatataaatggaatacagtaagccgatttgaataggcaagtgagagtatgaaatagttactgttgattttctttcgaaaaaaaaatacttttggaaaggaaaattattggttttagtccaatggtctgatggtgtcacagacagaaagcagaaaatgcagaaagaaagaagggagccatataatttcatacagtttttatctttggttagaaatttgcaaaggtggcttttaagtaaaagaaaagtgtccattaaagaacagtgtaaatgactaggcatctaaacaaatctttcctaaagacatttcacagagatttaaaaggaataaatattaacttagaaaaaatttcacgaaaaag

SEQ ID NO: 64700 - DNA, 682 bp, Bovine  19866881401043
caggtacttggtaaataatgatttgaactacacttggcaggaaattgtcttctgttatagtttccttattatgttatgtattaagaaattaaaaccaaaatgaactaatctatcttgatctcctcatggtctctgcttaaggttcattcttattcttctcctgtttcctgacttcctattcttttaatcctagaattgctttaatctcagtttctgagactctcgattctgcccattcatttaaatttgtaaacatcctcctggcctcactgtgtttctgccaaaccacagaactctgatccaatatgtcattatgttcctatttgcaccctggaatgtcacccttttcaccatctgccacactccttcttgataacttttacatccctgataaacacaaccatccactgctagagattctgctttcaaattcacaaatttgctgttaaatagttatagccatcataaatgaccctaacaaggatagagggtaacactgagtatgttctcaatggagatgaataatcggtttattaaaattaatatttcatcagatgctatagagtagctattctaagctcattttgccattttctcttgagcctcaatcccccatgcacagtaggaaaatatctatttctgaaaagaagctcctatctattatcaacatattaaaaccaca

SEQ ID NO: 64701 - DNA, 1781 bp, Bovine  19866881537113
atttaagaaaatactgtggatgttctcagctagaaatatagcaatgctattcatagaaatattaactgaactttgatgttataattcattgtgtgaattatatgcagtttaaaagcatttgctaatatttaaatgataaaaagtttttaaattatcttaatgtacaatatctttcttattgaagacctctgctgaaatattactcctataatgtctattcaaacaaaattcaatcattttagttttacaagtgagatttattagtgtatctcaattaaaaatcagggcctacttactgattaaatctatattgccatttagagtgtaaagtttcataatttttcaagaaagagaatattccatcacaaggtttgttttttttttttttttaatttagcaatctggaagatatttgtttttccaaattataaaattaacattcctgtaataaataagtgtccattttgtggaaattttaataaataatttgaatctcaaattttactgtagtatttttaaaattttaatattgaaatataatggcaagcagttaattcttagttttgtttttttttaattccctgtggaaataaggaagacaactgtgatttactggtagtttcttttacaattttattctgtataggtaacaaaacattgatttagtataatgacagcaagggttatgcttttaataagtattgctcattaatttttcttcaataattaagtctcttagaacataataaaatatccctatttataccaagtagagaaaaactgcagataaacatgattttagcaacacctgggacattggagagaagaaaatggtcataaccaaactaagtattaaattatagataggcaattttcagagaacaccatgtaaggttggaatataatattatcttaaatttttccatctttgtctacagctgcactccaattctgacaaaggtgatgggtctgtcaagtacatccttactggagaaggtgctgggactatttttatcattgatgataccactggcgacatccactcaacaaaaagcctagacagggagcagaagacccactatgtacttcacgcacaggctattgacagacgaacaaacaagccccttgagcctgaatctgagtttatcatcaaagtgcaagacatcaatgacaatgctccaaagttcacagatggaccatacattgtaactgtgcctgaaatgtcggatatgggtaagataaatcatttttatattttggaagttaatatatttttgaagatataaaataatattttgaagactaatatttaaatatttggggggtgtgaagaaatttgaagaaattccaaatattttaataattgcctatagcctaaagttttcaggaatatttctgctagctgtcctagtatttattaaaacaaatttctggagttgttagtgtaagtaacaacttgatctcaaggaaaaaccattcatacatgataaaatacttgcaattcttgcttaattggtgtaatttttttttttttttttaccataccaacacaattagtgacagtttgtgtcaacacatacagtagaatgttggaaatctattgctatgtgttttcaactttcaagttatgattaaattataataggactgatagtccaagcaatagttatattaatcaacaaaatttgcagaaacccttaagcatttgcatccctttattttaaaatatatgataaccatgtgaaatattttaaatgccacattaaagctatacaaactga

SEQ ID NO: 64702 - DNA, 828 bp, Bovine  19866881602638
aaatgacctagttacattcacttaaactctgacttatctctataaaaggaaaacctgactcagcaaaatccatcagcaagatcaaagactccttcttccttctatcttcaggctgataagagggaatagtttctctatttctacaaaaacacaaacattccttattatctctattctaataattagcagacagatataacaacaatattacattttcttttgacaaacattccttcttatctctattctgataattagcagacagatataacaccaatattacattttcttttgttttaaatataaagttcattttgaaacaagtatcacagcctcattactatacttagccatttcatattatatactgcttctaatggtgaatttcagtagtctctttgaaagaaacataaatcttagaagtcagataaaattctttttggcttcatggttgggtttcaggaaagtgaaatgaagtaggttcgaagtcctctctggagaaaacggagcaacacagctgttaatcatgtttgcggcaagcagaaatgcaaagcctctaaaataatcaggagacttacatctaaatgagcataaagatgaaatagatagaggtgcataaaatattgcagggactttttactattatgttcattaaagttccagcttaatgcatgctttattgcccagaaattcatttcatttgcattttaactgggttttagtcaagttaatcctttttcttcccttgcaaagaaactattcagcaactacagcaaaatactgaaagaggagaaataaatggaatattctacttatactaaaatttta

SEQ ID NO: 64703 - DNA, 772 bp, Bovine  19866881743315
gactgcagcaggccaggctttaagtatttaccaacattaattcatttatatcaataatttctagtgctgaaaaaaaaaaaagcaaaacaaataaaaaaactcaaacgaaaaactcttggtgtgcagcatatttagtaaaatccagtttcagtaatatctgttgtaaatgtttgggcacaatttaattcagtctaagtgtctttggactgcagccactgaaagccacaggggttctttacgagtaatctggacaagcttttgtcctcctcacagtgtttgagtattgcttgagcttctccatggaaataaatcatgcaacatagagcctgttgtgctgtgtccttaggagctctgcatgagcaaaaagaaagttgtgtaaataaatagtttcatctcaaaacaaacacaataaaatagaatcgatttaatagacatgaaatctcttataggcttagtggccaaattctctattcaaaggctcagattcacaataaagcagagtttagaaaaggcatgatgtttcctgtgtcagagacagggcagaggcttacaatatatttacatgcaatagaaaaaatgggtatatcatataaattattcagtattctagggataaatgtcttaagcatttcttcacccatatcagacttgtaatttttcccttgaaaaaaacttttttacacccagtcttgacaaaattgctgtccttcattagaaaacagctatcctgctgtggtattcatcaacatatgattttactaaaataatatgt

SEQ ID NO: 64704 - DNA, 1941 bp, Bovine  19866880886273
caaaaatggaaagataaggtgagagtgaattacaagcccttgcaatcaaatttgtggggttccccctataaaaatagaactctattaaaactcaaagcagaggaggactcatgaaggctgctgagttacaaggcaggtaaaccccataaagataaaatagtttactggttaacaaattaatccaggaaagaaaaaaggcaactaaatgaaagaagacactgttgcgtggtattattagtgattactattataagatggaataaaatggaagcagacaggaaggtcagagaaaagaaatggtttacaaaatatttctcagaaatttagaaacaggaagattttgaatcaacccctctgtattatcacagtcttcaaagaattacaaaaaggacgttagaaacaataatcagcaaagtggaaatcatttccagccaacgggaagaaacagaaaacaggtttgcggatgagggtaaagccaaaaacccaagaaattccataaattgtgctttaaaacaagagagggccctgaagattggcagagtaggaatactcttcaaggtacaggtaaatgtgaaggaagtgaaaaataaaatagaaggaaaagaagaagaaaatgagaaaaattttcataacaattgaagatgtatcatagaaacaactcaacaaaacctgaaagacagacccaaataagggggcacctggagggctaccctggtggctcaggtggtaaaaaatctgcctgcaaagcaggagacccgggtttgatccctgggttgggaagattccctggaggagggcaatgcaactcactccactattcttgcctggagaattccatggacagaggagcctggcgggctacatacagtccatggggtcacaaagaactggagacgactgaagcaaccaacacacacacacacacacacacacacacacacacacacacacacacagataattagtggccagaaatgcttgaagtccatgtgggaagaaaagatcttaacaatatatggaagaagaaaaatgttagcctgtatagctcaacttaaaaaaatagtaccaaatttagcaacagccactccaggcaaaagcaaaatatatggtcgctgagtttaatactccaaccaaaataagagcccaggcccagattttgtttccagccaacatgtgtctttacatttaaggagaagagaagatgtttgcccacctagaaaggccacaacaattaatcattcttggtgctgaaacaaaacattcagaggtcagaaaaatgtgttattctcttatctcaggtggggttaagatatggactgtgttaggttgggcaaccacccatccgggttatgctgggactgaaatgtcctctagcgtgagacacttgctgtgctgcagataagacagccctgagcagactgggaaggtccatcaccctagcactagtttccgtcacatgacaacctaggcaggctaattaggcttgacagtaaaattaacacagagaattctcgaaactcttcaggtactgaattttcaagtttgttgttttcttctgtcatctaggaaaatgttcctagaatagttagcatttgatcatttattcattcacccagttaaatagtgattgtgggctttttcatgccttgggctgggtgtgcagttccagtggaagcacatttctgacttcatggggcttagaggaaaagcaggaaagctgggtgtgaaatacataaacatgaaggtatgtgtaattggaaatgtgatagaaggtgtgaaggaaaaggacagcatgatatgattgaaagtgatcgaagatgtcatttagactggaggaggggcattctgggtgggaatgaccctctgaagaagggacaggaaagcagagacctgagggatgagaggagagaggaggcagataaggataagctgcagtgggga

SEQ ID NO: 64705 - DNA, 896 bp, Bovine  19866880924570
atggaaaactggcaggtcaccctccttgttctgggcaccgtattactggcatacaatgccatctatttttgtcacctttttgtcattccaaaacagctgtacaaaagatcttatattttactttattgttgcttattattaagtgaatatgaaagttaatataaagtgtcaagatagcatgttaaagtattttaatatgcttttgtttttcccacaccttgtacattatattttctcttttcagccagaggatcattgccttgaagaaagtaaagattgttaaagctggattgccaagagaaagatgtcagttcaaacttaaacttccaaacaatgatctgaaagttgtaagaatcaagagtttcgttttcaaaaacgatgttttgggggagatgaaaagatatatgggctccaaagagccaaatttagaaggctcagtttttagtgtttaacataaaccagtaagcagataagaatgcaggatgtgaatgagagtaggaaatagcatggccttttcagcagctctgagtcctccactggatctcagaaacatctcaatttcttccaaagcatatgcaggcaaggagagcttggaggggcggtgcagcgctgtcctcaggtcctctctgctttcacacatcacgccttcacacctacacacacatctcaaaagacctactaggtcacttctcctagcgtacctgatggtaactgggcacctctcccacccaccccaacatcctggagttacaaacctctctgggattctccatcatccatgatttttaacgaaatcatgttaaatatctaatttaagtatgtatacattttaaaagcacacagagcatacttgtactgcggatggattttcacatgcagacagatcagtaaacaga

SEQ ID NO: 64706 - DNA, 1480 bp, Bovine  19866880428074
taattaagaagccataaacttgtgtggaatattaatcctgccccctgccctccccagtctcacaaatcctgtgtttgaggttcattttcttgactttctgttttgttatggccccatccatctaactttagagaaaaggagccgaattaaacttgacatgttttctgaaaatgtgtttttgatgattttgttcatcagaatacatacctatgcgaggacttggaacaaggggaaaacaccagtttaattttcccgaatagctagttggcttctatgggtagaatatggaggtctatatatgtcgtcttgagtcctgctggagaactcctagcaatgttagaggctcatctctgaaggaactcccaggcatcacagtgttccctgcctttgacttcagtcatcctatttctcgggccttactttcctgtgtcattttgcttgaatcttcttgtgatgtttccggatttgtaagttaaccttgcattctttttggaacacggctagctataaataatgaagaagttgtgaacagaatgctttagagagactctgtgttgttgtggaatgagtgtgggctttgaagtgacatagatttggatcggctctcaggtctgtttcttgtgagttctgtgaccttcatgtttcttaaattaatgtgacaccttccagtgatgtcataactgcgaatgaaccccctccttttagtccccagtgctatcttctgtttgtgtgttttctacccgtgtgttgctttccagtacagttctcttacgctggcaaatgaggtgaggcagtcttacatggttttcacctagaaatgaataccaacaagaaaagccatctagaaatccaggaaagagctatattctctaagaaaactaggactgagcttcagattcccttgtttagattatggtaaattgtacatccatgactgaagtgacttagcacacatacacacaaagtatacatctctaaacctttaattctttattccgcaacaaaatttcaaatctgttctgctgcttgatttgtgctacttattttatggtttcaatcagaaacacaagacaaagcacttaatttttttgactaccatcaatatttacccctgttaataaaaacagaactacttctcagtgatacatcaaagggatagtgtctatccttgaaacaaacaaagcacatatcagagcctaacaagtctcttctatctaatgaatgaatttacagtttcaaagaagaataaacctgtcaaagggaattaaatgatatgttgcagcaggaataacttctgtgtctggcatttctggtagattgttagtaagaggaaaataggacatgtggaccttgataataaacctgtctttgatattattgttaagcctgactcctggagattaaagtggcaggtagtaaaatgtatcatgccaacgtaaatgggatgtttttgttctattttaagtttcttgtggaaaat

SEQ ID NO: 64707 - DNA, 2251 bp, Bovine  19866880428490
agagttggactgtgaagaaggctgatcaccaaagaattgatgcttttgaactgtggtgttggagaagactctggagagtcccttggactgcaaggagatccaaccagtccattctgaagaagatcagccctgggatttctttggagggaatgatgctgaagctgaaactccagtactttggctacctcatgcgaagagttgactcattggaaaagactctgatgctgggaggaattgggggcaggaggagaaggggatgacagaggatgagatggctggatggcatcactgatttgatggacgtgagtctgggtaaaccctgggagttggtgatggacagggaggcctggcgtgctgcgactcatggggtagcgaagagtcggacatgactgagtgactgaactgaactgatattcttctacttctctgtacattcatcctattaatttctgagagtctgatattgaaactccaactaaaacttcttaatttatctacataaaacaaataattgtaaaatatagtggaactatatgtaaccttgttctatattttccaagtctcctgtaaatgtgttaccacactttcataatttaaaagaataaaactttttttaaaaaattgggggaaaaaaggaacatgcccaaggtcatacatctgttaaagaacagaggtatgattttcacccactgaattgggaaatatttaccctgattggataagtagacactggagcatttgctctgaaataagacactagatattaataacatccttaaaatttataaaatgtacctcatgtatactttgtatataaataattaccatatgtttataagctcatatttttaaaataatgctaatgcccacttcaccatctttttctccaataccccttctaatacagggaggaaactaaaggttgcatagcacctgggtcagaccagagcttagaaacccaaaatggtaatgaccaagtgcgtcctgttatgtgcatagtcttcccctaagaattagctgtagtctttcctcactcagaagaatatgacaagtttttccacaaagagagtcaacatattttggttgaaacttcaccctgtcagagaggctgctctgccaccattagagcttttaagcaaggatgagataatcacaataattatcttccattagcaaaatgatctggcaccagattcttcctccggttctcacagcctcccttctggagtgaggagcatctgaaatgggcttcaagactatttgcagtggagaataatagagaagtataataatgagctagaggtaggtaaattaatcaaaggatcaggagggatgatggaccccaaatcagaaaaatctgctgatttgggctaatataacctagttttcatcttttcaaaggattctctttagactagccttttaattagtatgcttacatcatagcatcagtaaggcacaaaacatttggatgtatcaatccagcatttatccatctaattcatttcccctgtaagagtagtaaataaagctgataaaattatactcattgctttaattcaaggtttaatgtaaacacaaaaagtctcctatgggatttcaaaaagaattcataacctttgactaggtcttttctctcttttgctcagatataactagaccctgaaagaatttttccatttggtggctcttatttttaaaatcaccacctctatcaacaccacaactgtagtcagcatcatcattatcatcatcatttttaccatcaccattttctactgtgtaaggaatgctgttctgagttttttgaaggaagttgcaaagaaaattgaagcctatgcttgcccagacagtgtttgtaacaaaaggggggaaagtattattatattatcacattgatagaactgtcagtaaatgcaaatgacatacatcttaaaatagtcatctacaacattgacaaaaggaacgctagcaaaagacaggtctacaggtttcttagactcaccaggttgtctgttccaagaatgcagaggccacgtctgctttgtttatcactgtatacccaccaccacgtgcaacatctagcatttgctagggctccataactagtcattgaaatgcaagtcagggcacggttaaacagagggttagctacagtcattgaggtgaatatagttgtttctagaatttactatgcactgaaatcacctaggatctttaaaagttcttatgtctggccgatactcccaga

SEQ ID NO: 64708 - DNA, 1515 bp, Bovine  19866880480493
ttaaaaagtataatatgagtagccagcccacaattaatgaaggagtctcatttattttgtcttgaagttggttgttaggaatctgaaatttattttcccctagaaaaataaagcatagacaggttattaatttagactaccgtattttatttctttagagaatatagatgaatattaaatctatttttaaaaccctgttttctcattcacaagctacttctctgtagctctgtagaatacatttgcattttctagttttagataccatgcatatacctgttcccagtataacttctcccccttgcgctgagctaaagtggggggtagggggtcaccagaggtccaagtggtagcagtggccaaagcagagaaggaaggagaggaaatctccatggcaaccacagctcagctgggaggaccccttccccaagccttaaacatcttttgggtgaaggaatgaggattctaagtttcccaataagagcaggagttaagaaaactccagcagtctcttttgttgaggtgagcctataggagtggaagtatttgcatgaaagaaaggttaataactgagcatcattggttatctgatgatgtccaagttctgtgtcttactagttgtttatctatgtttagctccggacagaacgccaagcaaacactggggttttagtaaatactgaattattctgggagatgatccttggaagggtaaaagtaagtgactttggataggatctagctaaaataatcctgcttgaatttatatttcactctctagagggttgtgagtttccaaacatttgcaagcattgacatactgtggtatacatagagcaggggtggacactgtttctggaacacaaattcctacccccacatgctcaggatccaaaacagccatccaggaaataacagcagaggggacaagagcccacatttcagaatcaaacgggaacttgatttgaattatcgttctgggccacatggccaagtatctgttttctcaagccctccatttatttatgttataaaatggaaatgctgttagaaaaatttacggccaccttggatcatggtgaaggttaaatgagatattggatgtaaaagttgcccagtgcatggtaagcagttaataaatgctggcttacgagatttctcactttggggaaatgtaatctgatgggaaaatgagagccctcctacggacctgagaccagaggcacacctgggccaggagtggctttcagagcttgtctgtcaggtctgagctcccttaaatgcctgctcatagccattttggcagatcaggaggagggagggcgaggtgtgagcggcgagagtcacatttcctcctgtgggtttgtgtcgcctgccatgacttccacatccattgtgtttgtgctccaggctgctctattattagtttccgctgctggttctcctccagctgcgtgtccatcagggtccattgcagaatatcaatctgtcctcacgggcagaaaagccatgcgg

SEQ ID NO: 64709 - DNA, 858 bp, Bovine  19866880486356
ttcaggaaagggtgccagaaagaaccagtcgatttgaaacagcagttcacacatttcctgggctgttggagcgtgctgtacgtttcatttggcttgcactgccttcacctgtagaatatggctatcgaagggaaaacacacactggcaagcaatagtgcatgtagttttaagtggtgagactattcaagggaaatgattctattgtgagtaaagagtggtctgcagacaatgctaatcagcctaagttatcacagtaaattgtgtatgtataaacctttacatatttgtaaaatatcaattggaactgtatgaaattgatattccgctgtttctttttttttcttgacttgcaaaactggaatttcatatagttcagtctaacacttccacatttattattcctctttgaaaggccacctgccatggttggaagcacattggatttagagtcattggcttgggttcatgtcccaacaatgtcacttgtgtgctgggtgacctttacaaatccttcagagattgaacagtgacatgtgggaacaaagagaaatctaattcataagatatttagcagtgttttgactaatagttactagatagagagcctttttcacagtcatatgaaggcaggcagtcttataatacatacaaaaggctaacaaacaattcaaatgtgagtaattatgaatactgtttctgattatcaataggacattgtcaggttggaagggcaggcaccgttatcctcattgtatagttggagaaaatgaaacagaaattcagtaaaagggcttagatgattcagtgactcagaaatagggtctgagtctctagatgctattggcttttaagggtac

SEQ ID NO: 64710 - DNA, 1433 bp, Bovine  19866880502177
ctgtgacggttttaaagtcacccagggaagtcctaacaacttcctccacagactatctgccatgactgagaaagacgccatggaatggatatatggccacatatctcctctgagggattctgaaactaaggcttcctaacatcagctggcccatttaatctatctacttcttctttggcctttgaccaatatggtgtcattgtgctttcctaaactggtctttaatcactctgggtgaggaaaggacacttcttgggcaaatgggaacgcctttcccattctgtccaaggggccactgcctcttcaaccccgctagtggtcatggaggcagaagtgcagtcaatattgaaagtgattatgtcctaaggatatgctaatgacatcctaaagagtccaaggcaagacatgattagaagatgtgtctttcaacttccccactataaagtttaaatcaaatcaacatgtctggaaaattaattgttcatgtataagatacgctataagagtcattagaagccagtattgaaaagtagcacaatggatgatgcactcatgagtaaacagtactcagaaattgcaaaggcaaagaaatctatgtgtttcaataaaaacaggttctaagaagccataacactatgggtaaaaccatcattactaactgtcccagaggaaaagatgaaattagtcaagaatggtgcatttgataatgatgaaaaagaaggaatggttcttgagcctgaaaaaatggtacctggacaccaggaaatactgacaggtgtgctgatgtactttctaacttgctgccactgtaagatgctccaagctcatcttgaatatatactatattttaaaatgaaattgtttatatagatacgggtcttaaaaaaaatatttgtgtgggtctccacatacttgaggtcaagttgtaattcagggtctgcagctctaaggagaaccatggagaagacagtagcaatgcagaaacttgaagggaggagcaagatataattttctttctcacagttttactgcaaacaagtcctgctccagaaacctagtcagtcatatcaggaatcctttaaactttgcttcccagctgttttgggcttgctgataacatgccagttggtataaatattacatgatcccatatcccaatattattcatccgattatgtgagctagctcactgcaagatgactttggaattttaaataaagctatttttacagagaataatttggatatatctaggaaataataccatcatgcattgcaacaagatgtgatgttggataacattgctgtatggatattttacttaccatgcaacatgtagcctgtcacgtatttttacgaattttaagccttttataaaatatgtgtctatactacccccacagttgatcaccctcttgctttttagaattata

SEQ ID NO: 64711 - DNA, 2140 bp, Bovine  19866880538388
gttgcttcctgtcttggctattataaacagtgctgcgatgaacattggggtacacgtgtctctttcccttctggtttcctcagtgtgtatgcccaacagtggggttgctggatcataaggcagttctatttccagttttttaaggaatctccacactgttctccatagtggctgtactagtttgcattcccaccaacagtgtaaaagggttcccttttctccacaccctctccagcatttattatttgtagacttttggatcgcagccattctgactggtgtgaaatggtacctcatagtggttttgatttgcatttctctgataatgagtgatgttgagcatcttttcatgtgtttgttagccatctgtatgtcaagttacatttgggcactggtataaagcaagaactcttaaaaaatcaatcctctaagtagactgaggaagaaattaaagtgcgttttcttcacacctaaatagaatgaggcgacaataataaagccgtgctgtgtatttacttagcacttcacatttccaaatggcgccactatttcattaccatattcgtgtgctccacctctaagctttgcagacagtctactgctaaaatgccataaaatgtattatgcagcaaatgggttatggtttaggtaaatttaggtaaattgctcatggtcttgactgaacagcagtgaacccaggggacccatcatttccacccttcagaaactaggaagacttgaaaagatcaactgaagaggtgtgaacagtggctaaacacttttcctctttttttttttttcaacaaaaagaataataaattttctttctactgattgagctcctattgctccgacaaagtgtgggagccagatgggagaggaaaattagattaaaaaaattaatatacattttctttcaggtttgattaagggtgtgcatcagagaaagcacacgtaaacatgccactctttttaatattttggcagagcagtgataaatatatttatataatctaatcacaggacagattgtaggtgggcttttattacaatgattaaataatagagacgcagagtacatatcgataagaaaagtcaaactcaaaagggaggagatatatcatccagaatttaggaacacattagtttaattttgagcatggtacttagcccctaatctcacctgttttctttcctctagttcaaatatatgttagagtgaaaaatggccttatttcaggtgaggcatatgggccattactggccatgcgtctgtgttcatagttccttcatcagtaattcctaggataagacacagttcccattaaaaggccctgtaggatctcagttggagttggggtttggatgttgacatttaagataacaaggtctgtggaagttttaagacagatgaatccagattctatagcagacttctgagagggatgacatagggtaggatttgtcaacagagaacttctgtcatctctgccggcatagaaactgacagagctctcagtaaatactttcatattaagtaaacagtatttcagttataaatgaatgaacagagtaataaatgaaaaagtataaagaaaggactgggggttatatgttttcctgggaaagaagggacagtatgcagtttattagggagattaaggcacgaacctggatttaagaggacagtgagacaaaaggtgtaagtaccacccttttctctttcatgtggctggtgctggtcatgctgagagcagagtcctcagtacaggaagtcccctccatccaaatacaaaccttcaagttgtcaactttcagagatgtgaatgtaagtgccagccctggggtgctggctgttgtactgtactactacacttttcgagatactgtaaggatgaaaatgtttcttttttgtttgtttttatgtatgtatgatttgtgtgaaaaaatattgtaaaactattatagtaccatactgtacagccgattgtgttagttgggtacctaggctgacttagttggacttactacgaacaaattggacttttgaacacactctcagaactcgttcgtatgtaggtgacttcctgtagaccccaatttgaaccacacacctcttctatctccttgcctttcatca

SEQ ID NO: 64712 - DNA, 933 bp, Bovine  19866880732915
ctgtgacactgccctcaacactggcacctcaccatcaatgaatcagaattgtgcaggagctgatcacataccctgcaatacccctccatcaccctgcctttaaaaatgctttcctaaaacccactggggagttcaggtgttttgaacactatagttgccctggactccgtgccagatagcctggaataaacaatgcacgttccttccccacaatgcagtgtcatatctagaattagttttacaacattatattttcaactattgccaagtattcaatcagttaagtggcagatactatgttaattagcaatgctaactgatgaacggtcttaatttttactctggactggtgaggttagctcaaactactgcattctttgtcatagactaagaaaaacagagtcaactaatgagtgaaataataataacagtgaaagaaaatacgatgacaggaaatcatgctgagtcagcgctctgctccaagtcatctgttctcacatatgcccttgacctcttggggtgagcctctcaatccccgcccttgccgaccccccttcttctcccatctgcattcagtaaatatttactgagtgcccattgtgtgtctgcacctaaaggcaaggagtaaaaaaacttgaaaacaacaggagctggtattgattttacagatttattcttctgcagaacaaggccagcctcacccaggggcgggctgagcgagccctcctgctccagctcctgtggaaatgagccctcacccaggggcatcttgttctctggccctgccaggtgcctgccgttctcacattagtcaccacttttcattaaggccccgagagtctccctgatgcaaggcaaaggttacttgggaggggaaacaaattaaaccattaacacagatgagttaaacacattagcttctccctataggta

SEQ ID NO: 64713 - DNA, 957 bp, Bovine  19866880764900
ctttttaatggctgagtatactccttgtgtaaactatgtttttttaattagctataagaatgccgtcaaaagccagggccattgccacaatggcgcgcgtgaaaggtactaggcaggagcattctttccagtggggacggtgcactcccagggaaaggcaggttctgacaggtggctgctctgctgtgtggtgacaggcgtgcaatgtgcacaagctacatgtgcactttggatgcaccagaaattgtacccgagacacaaacctgggcagcgaggaactaattcccaacaatttcccccctaatgtttaaaaccaagacttgcctgtcctgccaagtagtgtgtagctgactttccctctgcctaaaccatctcaaacaagatctcccaacacaactccagaaataatgcatacacttgggggtttgaaaaaaacccagggctcttcaagctaattaccttggttaattaatatatcactccatttgtttcaaaactcattatgttcacaaaaggcctactggaccaacagaagaggaatgaaaataaatgaccagggaaacattaatcaaggggaaaaaaacatcatttgctgatggaaaaactaatatgaggattaccaaaatccctaatgactttccctcacaggggctacatttaaaatcatttctgagggcaaaaatgaaagctacgtctctgctaagatcttagcactggaactgaatacaggacttctgaacatggcaaatatcctaataactgtcactgttgttcaataatctttcactgggaggtgacagtctaagatagttgttttcagcagactttgggtatgctgttctgccatctgggagatggcctctgttttctcatttgtgaaatagtgaaattgcattattcatggtagataatactgtgttttgaccaatgccaggcattggaaacaacctcaggatt

SEQ ID NO: 64714 - DNA, 1367 bp, Bovine  19866880833028
ccactcccagtattcttgcctggagaattcccatggacagaggagcctggcaggctacagtcactggggttgcaaagagtcaggcatgactgagcagctatcactgggtttcccagatggcgcagcggtaaagaatccgcctgccaatgcaagaaacatgggttgggaagatcccctggaagaagaaatggcaacccgctccagtattcttccctgggaaatcccatggatggagaagcctggtgggctaaagtccatggggtcacagaagagttggatgtgactgaggaactaaaaacaccaacagcttgtggtaacaggtaattaaagcccactggccaggtctggttcatttaaaatcccccagttctcgtcgagcttcatcattttatgcatttatatatttaagaggtagaaaccatttctcatggagacaagatgtgtccttctggttctttagctgattggtgacagagtcagatttgctagggacttgggaagaaaaagagaggaaggatcttagaaatagtagtaggttttgagtaaagactcagtgtcttcaaagagggctatccatggcctttgaatgagcagggaggaaaataatagatgaagtgaatgaagggaaattggcaaagagagctcagttgaaatgtgagagaaggaataggttgaaaattataagttcctgcatttgaaaagtaaaacaaaaaataaaagaaattcatttagaattatctctcaatctgtgttaataatccaacaaaatgagcataaagtcatagtaggacttaataaaggaattttaactttactgtatgcattaaattcctaataaagagtttaatggttagctacaacaacaagaagaaactggatggataaaataggatgaaacacttggaaacaatggtgctaatgcaaaatgaatcatttgaatagtctagtggtatttttaattcgtgtaggaattgtatgccgtggttctctgactaatgccagcaacccttgctgttacagtgggaatacagacaataaactatggaaatgctttttcagttcatggctattggaaatattattgtcagcattagtgtccgggttcttaaaaatgctggaaatgaaattaacctttatagctaaatgcttgttaatatttcaattgaaaggcacactgaagagtcaatagcattctcataaaggatcaaagtcattaccaataaatgagagcaataacataacaaataaacatattttagacaaggtgagggtcaagcttcctcttttatgttaatacagtaagttgatgaactgtatagtgaccatggtcaatagaaagtggaagttaacaagtgtaattatttcta

SEQ ID NO: 64715 - DNA, 796 bp, Bovine  19866880910134
gtgcttgtcctaagtattcaaagaaaaaagtaaatcagaaaaacttcaaccatgtgacctctcccaattctcctgactaaagtttatctcagcgtttgggtctgccaactatttgatctaaacctcttctttgaccccttcataggggaagcctagcagttaactcagaaacagtatagtttctggaagttgacctgagccaactgaaaaatgtcctgagatggtatcagcatctttatccatttttcagaaaaagcttgttgattcaatattaactcctatagctcttacaactccctttgggataaatatttaatcaacagagcagttgcctttttatttcattatggagaagtttcaataaaataaaatagtgtattctaatgaatgacaaacactggtgaattttcatttaaaatcaataagttgaaccaaggaattgttttgtaacttatgggtcatctcaatttaatgaacagtaactaaaaaaatattatataaatgcctggcatgcagaagggatgcagagcaaaaggctagttattgtccccctaggctttataatccttaaagaaagggatgcattttgttattttttccttggccaatgcctggaataatagcaagcaggtcgtgggtattcagtgaatacttgccaggttgaatgaattaataagtcgatgtaagaagagtgttttcctttagagaaaagcacgcagtactttcctcatcatggtcatctctcagtgggatgaccctgaccacaggggattataaatcatatatattctttttc

SEQ ID NO: 64716 - DNA, 791 bp, Bovine  19866880927222
tcaatcgcagcagaaaggtagcaaagcagatgagataatatacagggtttattcctaagtcattcactctcccctcaggctttaaattgtgattgtgacatagataacgcttgagaaagatttatgaggaccctaccctagtccccatctgtctgcaccaggagcccctaatacaaacatttccaaagcaagtgagggaagttctgtcttgggagtcattaaaaagggactgggcaaaacactagagaatatacagcagggaacgatacagagcggctccatggagaatcagctcactgtgacctaatatttaacatcgatagttgacaatgttgaaacattaatggtaaataaaatgcagtgaaagatctctgttaagcaaggatcttgtgttaatgatggttgccaaacaggcatctgatgggggaggagtagcgaaggggaggaagaacacttacttcatctgaagaccaggaaatggactagtttatcttactgcaacaggaaagaaggtgaaatagtaaggtttatacagttcaggtttccagagcccaagtgcattctatgtgccagatactagagcgctgattcttcaaaacgagcctctaatgaataaccattaatcccaccatagagaagacagatgtaccttcacaactcttcccctgaggtaaagatgaggaaatagatcaaaagtacgcttggggaatctgaaatcacttagccaactgagagactcaagaatgagaaagatcaggttgggtcattgctagtggcaatcagtaactagt

SEQ ID NO: 64717 - DNA, 2018 bp, Bovine  19866881085525
tgcccacagctaaatccatcactggaagaggaaaataaagtaaccgctattagcttaggttgatcacagtgcatcctttatagctccgagggcgtctcagtttgttcagtgcatcgtcaagcaagacttgggggaaaagggaaaagggctgacagtggttgctaggcaactgacagtgcctcccccatgggtcccagccctggccccagcccctttgcccagtcccatgtggtcactctgctgagatgctcctggggccatgactgctcatggaaggccagctgtcctcacagaagcccccagcactgccaccacgtggggctctgcgagatgttcactgccctgccctcagctcccccatcctgatcactgaaatgccctccgctgttgcacaatggataagaccctggtgttagccttcgtggtccagaaataaaattccccccgtcataggggagctgcgagttgagatgagggcgattcatcaccagatgagaggtgagtgggaaatacgatcaatacctcatttggattcacttctacttatatctgttttctacagatttggattttcactgaaattattttagcagacgcagcgacccaatctacaccaaactgacttggactctttccaaagttctctgtgtccagaagagtttaagattgcatctctctttcccctgtaagcctcgtcatcattctcctctgcattcccacgcacagccacagtacagcctccaaaagagcctaatacagagtgttcttatgtcttggctttggtcctggactgggggcaaccaggtctaggctagaggctcgtgcagagtaacccttcccccacccctggccactgttggcctcctgctgccctgtgagggcatctgggctggaggccgtgggaagaagaccacactgtcaaagggaagatacccattgaatggcaaaagcgacctgtatttctaaggttgctgtgacctggccacagtggagcagtgagaggaaaaaagacttgtttacaaggtgatggattataggcaagagactaagaccctgtcaacatctgcagcatacccattcattaacgtctttcataatagtataggaccttgacatgtcctaaaaaaaaaaagccttaaaaatagactcctgtgcttaggaatcgcttcctggcatgcctataataattaatgtctctggacagatttatcattctctgaacatattctgagcaccttctgtgttcaaggcactgcagcatgcactgggatatagaaagtcctccaggagttcacaattcactgagatgcctcctccatttgtattcttaaattcatgcctgctacgtgctatcattatgtactgtttgtatatccccaagaacattatatcaagggataacctcagcaatttgttttagaaaaataacaggaataatgactttttaaaaagtgttttgccaagcctcgccctccccaaaaggctccctgggtgaactggacttagtcctggagcatctgtggtccatatgtgtatattcaagctaagatgcaatgaaatgactttccccaggcttccacatgcccgagggtccccacagcacagagaatctagcagggcacccctaaccgcccccctgcccaaggttatatagatcacattgtgctcctgaagacccatcatccttattgccagacactgggctttctaatcacttcatattcagtcagagagccagatgtccaaacccagctagacaaatgcaggacagctcagcagaagcacttctaatgggtgtcatcgctaaggtcttaaagaaccttcccttggctccatcctggacaagcatgtcctatagaagagtcacctgtgttgacagacagccctgggattgtaccctggttctgttacttgactggctggggtttgcttggataaattgatgtttaagcttcattttgatcttatgatttctttataaaggggaaccatcatcattatatctatagctgaaccta

SEQ ID NO: 64718 - DNA, 1281 bp, Bovine  19866881121918
tgcaatgcaggagacctgtgttcaattcctgggcttggaagatcccctggagaagggaaagtctacccactccggtattctggcctggagaattccatggactatatagcctatggagtcgcaaagagttggacacaactgagaaactttcactttcactttcataaggctaagaagtagctgttattaccacttccttttatagacgataaaaataaggcacagagcagctaaggtatttgcctaagtttattcagctggtggggcttccctggtggctcagcagtaaagaatccacacgcaatgcaggagatgcaggagactcaggtttgatctctgggtagggaagattgcttggaagaaggcatggcaacccactctattattcttgcctggagaatccccatggacagagcctgatggtctacagcccatagcgtggcaaagagtcagctaagactgaagtggcttagcatgcatgcatcccgctgggaagtgataaagccaaggtgtgaagacagacctggtttgttcccgtactctgtgctcttaaccacgtcaagctggcattgattctctgggccacatatttgagatccaatccattgcaactattagaattacttccggagctgttatgattgaaacaagatctgaaagagaagtaatcctggcagtgcagaaatgatcattaagagaaacagagggtagccaaagaaaacattttttttctccttcaagctttttctaaaggctgcactagaatgagacaaaagcctagaataccaatacgctgataaattgcttaccaatgctgaacaaatttgtcaacaattctatctccatatgttatatatgaaagaaagtaaaatcatctaaaattatccacgtgttctaaatggaggattagaaagggaacacctatccaggcccccacccacaccccacttgtgaaggcaccttaaggccccttgaggattggccactgtttacttgttaagcctcacatgttccctttttccgttcaaattctgcattccagttatgtggaaatggattcatttatctgaaaatgctccagacgtttcaccccgcaggtcatggtactggctgcttctgctccaggttcccctgttgccagcctaattcttcttcctgattcaggtgaccaagtgggcatctctgcacaggaactcctcccttaccctttgcccaggtttggggctttgcctcttgttcatattacatgctttgtagttcccaccaatgccctgcagcttg

SEQ ID NO: 64719 - DNA, 902 bp, Bovine  19866881165400
cttaaagcacactttctctccagaggttctggaggatagacattggaaatcaagttgtcagcagggatacacttcctctgaaggctccagggtacttccctgactctccttccttctgatggcccccagtgttctttgacttgaagcatcacctggtctctgcctccatgaccttctctgccttctcctcttcctgtcagctaccggtctttgagtttagggccatcgtacatctagggtggttttgtctcaatatccttatctaattccatctgcaaagattttatttccaaattttactctcatcacttaagatatattcttatggatttagacttgctctgtccagagttctcttgttagcaatcaaaaaggaggaaaggtttttttgtgaatgcgttttgggattgtttgctctggagctgcagcaacctaggagtctcaaaggaagacaggaagtaatgatgagacacagagagggtagatgagagggaaggggttgaacacaaatttcagcgtatttgtagtttggataaaggtttggccaagagtacattctcctgagaagccttcacagaaggggactgaagaggctgtcaaccacccagtgaaaacctccatctatgggtttgctaacatgacctctaaattgcattggggcctgcatcattttttgaaactgtgttcagaagtacagattgtaagtctcacttgcaacaacaaaagcaatttctaattgcagagaaagcaaactgccactagcaaagcaaatccactgctcctcattttatggaacgtgcaaattgtctctgttacacttaaacccccaaaatgtcaatttgcagaatccatctggcccgctccatgaatattttttgtagcattttaggaaaagctttgct

SEQ ID NO: 64720 - DNA, 1403 bp, Bovine  19866881247619
tcttctacacgctagagcccacccacacccatggcttcaccaatcacttacaatcattcctgagtctccattccagacacacatgaatgagtaagcaaatgtgcccctgactctcagaggaaatagcacatcagatcatgctgtttgtgttttgttttgcattaattggatgcccagcattgagttagtaacacagacatgatgggcaatgaaataaatgcatttcattccttgttatttcgaaccccaatgccttaaagggaccatatacttcacaactgcacgattactgaagagttgttagagcccattctccttgtctaaaatactattttatctttagcaagttgggattaattttatagtgccacttaggaattgtaagagggcaaagattttctgcagccattcttagtggcactcatattgtcttcatgaagacaatcaggaggatggggagaagaatgcatgttaaaatctgtgctgctgtactgcttgactccggctacatctttcttcaacccctgcagtctccctgagtcactaagctggtatagattttgtttctggagttagttaccaagtcccaggttactgggatcctgaaattcctataaaccctatacaacataatacaacttgagtcctagactctgaataccacctggaatagaattgcatggaactagaagagcttagttgagcccacaacttagttttcttctatgatctataaagacagaccccaacccatcgaccctattctctaccacatgtctccagcctccccaggatctaagccccaggggaaaaaatgaacttgaggttaactgagcagctggacactcagtagctagaaagacgtgtgtttatgcatcttgtcaatgattttttccccccactcccaaggtgttagttcctgaacgcaatcactttacaaccaattgttgtctgcataatggaaattcaaaccatgtttcctaattaatctattgtgttctctctaatttgcatgaaacattgtaggagcaatgccttgtaagtgcctttctctggggccaggggttgttagaaacctgcttcagaaaagtgtctctgcaggggagaagctagacaactttcagcactgtcaccttgtcgcctgggctgcctctcctctggctgtttagaggtgaacagatcctgcgtctcaaagtctctctctaggtctgtgtcctcagtactgaacaggtaagcacagagctgtagcaaattgatagggactggctataccagaatgctctaacatctgctcctaggacctgtggctggatttgaagagagaatttggtcctgcctcataataaaccattcatgtggctcaaaaccctttcttccagaaagcaggatgtgaagtgggagtg

SEQ ID NO: 64721 - DNA, 2204 bp, Bovine  19866881360421
ttgcacggatggtcacactatttgtaaaagcctggccattcctgagaatggatgaatgatggtgattagttgtgttaactccatttatccaatcactcccgatttctgtgcatccacatttggtggccagctgtcctaccaggagctggcaagtcattgaccttgatcaacgggttaatttctttcttgaatttgtgccaagatctcacatatatctctgtacaccctcatttaaagcattggatggttatctcgttaaaaatattattaagggcactggtagaaggttccaatttactttgagtaagctttcatagattcctcagataggggtgagggggaggacatttgaacttcacaatgattttagtcctcagtctttctatttcctctaaccatctaacaatctatggttgaaatttctgttttgggtacatgttgatctcacaacctaagagtattagaacctaaaaggaaaatggaatttcataatttttttcaaaatttgtgggagaaaagctgagtcttctcttgtgatccctggtgtggccacgctggggagtagaaacagagtctaaccacattttctttgtctgcttagccccctatgttaaaaaggagcattgacttgcctaggttgctttttagatgcttctctgggacttcatttgctggtttatggtccagtaggagactaagagctcatcataaagtctgcattcagaccaggttccgctcagactaattaatggaattatataatcgatcgcttctgtttctatttctaggcctcctacattttgagatgagaacatagaagtggcaatcgggttcacaagggcacccttcagagtccctcatttctcctttctcttcgatggcacagctcataaagaatacagcacattttctttccttgaaaggttcttggcactttttttttttttttttaagatacaaaaaactcccttgaccattcaagtggtgtcttctttgactcagaataatgtatcaccaggaatatttggcaggcaaagatgcaattcaagggaagttctagagtaaaggatgtggtagcccttgaagaaagccatggagcaaaagaaggaagattagtttctaccagtggaataaacaaattatttaaattatttagtgttcagccagtaggtaccaatatgggtgttcagatttctaaaaactaaaatattttttcactggtaaatatttaccatccaggaccttccaaaatgtcctgccccctctgttctgattggccagtcaattcccagaaagtcttgcttctaagatactaggattagctttttccccaatcactttggaaagccaaatgaaccctcacaagcccctgggtcacctttgtgccctccagcctgccagccagactgctcagcatggctccctgtatgctgaccttgcagtaacactgggctcctcgaaattgtgacacccacataggttggtattccctgaatggctgtcgcgtggatgtcagtgggagcttcagctctgacagcagatgaggccagttggagggctgagtctcagctgtgtttttggttaactttttgatactatgcatcctttgatttaattacctttgttctgtggacacagtcttgactgatcttgtgaccttaaagctacataacacacagtgatgtctataatggctttttaaaacaattatttttatctcttttgccaatgaaatggtgttcagtgaataaagctttaaaaaagatgaatgggaaaaaatataaatcactcattattgcatgactcagagacttactgtaggcattttggtattttatatatatatatgaaaagtaaatgaataatctcatatatacttgtatagctttttgtgaacacagtttcaagatttgtaagagttgagtgggaactttaaagtcaactagtttatcctggccaaggaggggaaaaaaaatccctttacatgacatccctctcaaatattctccagctttctccttggtatctcaaatgacatgggcccatggcttattattcctctcccttcacctttagatcattaactattctggaaagttctattttactcgatctaaattcttctttcctatcctttacccatagatttttggtttttcccttcttagcaaacacaaggggggttgaaggggcacagaattata

SEQ ID NO: 64722 - DNA, 679 bp, Bovine  19866881407034
ggatgtcacccaagaaagatctctctcctgagtgacagcagagacctccgtggcacccacgtgcagaggttggtaggggcccagtgttcacagtctatcttctcctccacaaacaaggcgaggtgttttatgctagcagcaaagtaatgatgctaagagactgaatgattaaatgccagtctgcgagccagagtacatttgttttctgcttgaaaaagccactttcattttgtatgacagctttcttaactgcaacatagctcagaaaatgacagagagcgaatgagaataagtgattgtaaaatggcaaacaactatttgctactatttgaactaccatttaactgttcattcaatttctagtcagaagccatcactcagctgtggaaccagaatgtaggcattatttatttggtggcattacaaagccatctaatcttggggaaaatcttagaggcaaaaatcagaatatccaaaaattgccttgacatttagtggcaaaatacaatgcttcactgtggctttttacttctccatattcttttttctcattgttgcaactgaaatacttgaattccattcgcattctagtgttacatcttcaataatatgattttttttccccacaagctatctgttagcaccgggcagagctgaagttttgtaagatgtgcttgga

SEQ ID NO: 64723 - DNA, 743 bp, Bovine  19866881438581
tttctgttaatcgttttcaaatgtcacagttttcactaacaagttataagacagcttcatgcactttaatttcctctgaaaagaaatccgctgccacctttatgaaagactaacattccaagtacagcttttgaatgctaatgccctaccttaactgggctaagctctgtaattcacatgtgttgtaatttctctcccattgtagtgtaagggcatttcacatagttttgatatattgtataaattaggccaacaaagtgctgtgctatgtcttcattaaaataggagacggtaataatgcaaccatgtagcgtggtcttgcagcctttgaattatgaacattcaatagcatctccttacttgtgcttaagttggcatttgtgagcagcatataatcaattaatcaataacccaattttctgttaaagagatggtgcatcatttaaaaaaaaaaaaacggggaccattgtatgagtttatgaaaaagagccttgtcagcaaggaaacttgtttgaaaaacactgaaagcctttatttgggaatgatgattttgcttaactaagccaaaagcaaaattggatacaaatgttcagttcctgaaccattttattattttgctgtggctagaaagaaaagcatccatttggaattgctaggaagaatgcattgttttcactcatgattagatatggggtaagtggattcatctatggaaatgcagagtgaaaataaactaatcctaa

SEQ ID NO: 64724 - DNA, 865 bp, Bovine  19866881534114
ctatctttctgcctacacagcacaagtcagtaacttacataattcttccgggatattctaaaagccccaaggcaggagttcatactgtatacatttggcattcagaatcggatgtggaagtgaattcattgacatccagggagaatttccaaatatttcaaaacaatttttgcagttcctcctatttgcattctttagtgtgtggtgtcctgctaatgtttgcctttgtcatatatttgtcatacatgtaccatttggcattctgattcagcaaaactaccatatttagttgctttgccttttagaggggtttattttacctgatggagaaggcaatggcaccccactccagtactcttccctagaaaatcccatggacggaggaacctggaaggctgcagtctatgaggtcgctaagagtcagacacaactgaacgacttgactttcattttcactttcatgcattggagaaggaaatggcaacccactccagtgttcttgcctggagaatcccagggacgggggagcctggtgggctgccatctatggggttgcacagagtcggacacgactgaagtgacttagcagcagcagcagcattttacctgaagaggctgaaaagtgaaagtagtagttcctcaattgtgtccaattctttctgacccctcggacagtagccctccaggctcctctgtccatggaattctctgggcaaggatactggagtgggttgccatttccttctccaggggatcttcctgaaccaagaatcaaatccagatctcccacattgcaggcagattctttaccgtctagccaccagggaagctgaagaggctgtaagaccaaatcaaatcagggagg

SEQ ID NO: 64725 - DNA, 757 bp, Bovine  19866881720971
tagagtagggtgggaatgggactgatggggttagaaccctgatggaaattaagattcaagctctaatagttgcaagtaatctgtctgtctgaggcttccctggtggctcagtggtagaaacaatctgctagccaatgctgcagatactggtttgatccctggatcaagaagatacctggagaaggaaaaggcaacccaccccagtattcttgcatggaaaatcctatggccagaggagcctggtaagttacagtccatggggtcacaaaagagtcagacatgacttagcgactaaacaaaaatctgtctgctagacagaaagacactggggaaatttagaattattacctttaattaatatatgtcctttgttctacaaacctttccttaattctaaccccctcttttacccacactctcttctataatccccttaccacatagcttagacagcccaagaatctctcctaatggcttaaatggaacaactcttcctttcttgggtggcaggtagaaagaagagggtgataagaactccttctattttcaggaaaatgaaacctcattccatctctacctccacccccacaggggaaaaaaaagtaaaaaaaacacttggctcacaccttcctgtttcaccaacccaatttttttcctgtttcaagcacaaaagtaattacgggcctagctataaatatcgagtcttttaccttgacagaaagcgggaatgatacaagggtttaatggtattatttat

SEQ ID NO: 64726 - DNA, 718 bp, Bovine  19866881871795
tgaacttgaataaaatgtgctattttaaaaaagaaaaggaactctgcccaaaacatttcctctgctgaatctataaactatacaaccccataattgctttcttctctacttccactggaagtgttcttaggaataataagttgatatttgctaagtgctttgagctccttttgaaagaggtgataaaaacttctctaaattatttttatcacctccataaaatttaaaagcaaagtatcattccttctcaaaagcgggtcttaccctgattttcctaaattataacctctgattagctattgaaactccttgattacaggctgacattgtgttatcttgggaatcatcccagttaaatctgtgaaaaaaattgattgtagcatgacaagaccatgaactattgtagtttggaacaaagcttcaaaatagtgcaataaatttgctgcttaagttctcctggtttcaaatatgaggtcaatgcgatggctttatgtattgattaatcctgtcagtttgatttatttacttcctaataaccaagaaggatttgtaaggatttttcactcttcatggaaaaccctcacagtgggaggaaacttgaggagtcttcacagtttctgtgctcatcctcagtggggaccgcaacctggtgaattccacgtaccagcaccatcactcgcccatgaaaattctgccacgtcttcatgggatgatcaaa

SEQ ID NO: 64727 - DNA, 1218 bp, Bovine  19866881933842
aaaattggggattatttatctacatatttatgattgattatttgcaaaaagatggaagaatcttttcccgagattctgcatagtctttgcaaattaggtacatggtgagtcccctgggagctgtaactctgcactacacttaatatccaaacagctggaaggaaacttaaaggtcaactactctgattactcatataatatataatgactatacagcatccctgacacacagccataactctgcttaaaaacattcacgaacaagaaacttactacctggaaaagccattcagcatcttttcatgtccgattggccatctgcatgtcttcctcagtgggatctaaaatattgcacgaacggacctatctacaaaacagactcggacttagatgcagacattggggttggcaggtgggaggggcgtgggagggatggcctgggagtttggggttggcagatgcaaactactacactgagaatggataaacgagtgctaatgcatggcacagagaactatgttcagtattctgtgataaaccgcaacggaaaagaatatttaaaaagaacgtatctatgtgtataactgagtcattcttctgcagagcagagattgccataacactgtaaatcaactatacttcaaaacaatttttttttcccttaaaaagccattcagtccatgtttgggcattctaaaggttagaacagtctttgcagactttcttggcttaatacccataataccaaaaggtggtacttctaaggaaaagatagctaaatgtgactacatttaaaaataataataaacaaaaatatccctgaatgtatatggataggttagactatactacagtaaaaaaaaaaaaaaaaaaaaaaccaaatcttagcaattcagtacaacaaaggtttattttgtttacacactttgtaagtaggaggcaccacccattttttgtcacttggggacgcaggtagacactgtccccatcacatgctgtcacaatcagcacagaagaggaagttacacactcgccgacagggaacacagtccctggctcgcagtcagacactgctgagggttttagcatgagcccacgggcgtaaccaccactactctctttaaagcaagtgtgtgtgcactcagtcgctcagtcacgtctgactctttgcaaccctgtggacggtagcccatcaggctcctctatccgggggatttt

SEQ ID NO: 64728 - DNA, 675 bp, Bovine  19866882172569
cttactgtaggagatgaactctgacctctcgccgtatcactgaaattccgaactcatggagcatgagggagaactgaccactagagaagagtggattatgtcaacctcacgtgttatatatatatatatatatatatttttttttttttcaggaaggtgttacctgattggaataataaaacttttaatatacttcgaagttagtacttttcggagatcaaagcacttcctaatggtattataaaatcagtagtatgacattaaccccaaagcatttaagattttcctttcaaacaagacttcaagtaaagcaaatgttaaacttgacaattaaaaaaaaaaaaagatgagcaatccagattattttccccataggccaattgaaaaaaatatgcaaaataaaatgacatgttacatatatcaagtgggtaatagtaaaaaataaaatgcaaattattatacacttttataattacagcacgaagacaaattacagtaacctttagtattctatacttttcttcctccttcagtagatggttgattccttctatttctgtgctttagagctgtgctaacacatggaaattcagtttggctgactgatgatcaaaattactatagtgctttaaagttctttgacaaattttagcctggggttacaaaaccaggtct

SEQ ID NO: 64729 - DNA, 3118 bp, Bovine  19866880167841
tctccctctcccacagaggccaaaatactgttctatacatctgtgtctcttttgctgtctcacatacagggttatcactaccatctttctaaattccatatatatgcattagtatactgtattggtgtttttctttctggcttacttcactctgtataataggctccagtttcatccacttcattagaactgattcaaatgtatactttttagtggctgagtaatattccattgtgtatatgtaccacagctttcttatccattcatctgctgatggacatctaggttgcttccatgtcctggctattataaacagtgctgtgatgaacactggggtacacgtgtctttcagttctggtttccttggtgtatatggccagtagtgggattgctgggtcataaggcagttctatttccagttttttaaggatttctttatatttgtgtatgtaggagtcagatcatgtctcagagttcccaggaagatctgatcagactattttacccttaactccagtattgggaatggtactggaattaatatttgttgactttaaaaaatcgttctgctttatttctttatccacattatgaggaatttgacacatacagagcaatagttaaaaaaaaaaagattctcataattctgttacccaaagaaagcctttgttaatgtttgtgtctcttcttctagtctttgtattatagttttccacatgtatgtagaacatagtgttaagaccataatatcattggaatcaagtggatctcaactcaagtacctgttcccctaccagctgtgtgaacctggataagtaagttagctttgctaagctttttttctcttacatgaaataaagataaaaattccaatattctatggttattgtaagaattaggtgagcttatgtgtgaaagttacattataatcctcctttagctactgttaatatagtagctaatgttaatgctattagaggtgtgataataccatgtcttgctttttccacttaacattataacatattttttagattattacaaacccaataaactcatatttaacatattttactaaatttttatattttacacagtttcctttaaatttctactatttcaagaattctttattctagaaaatattgtcaaaagtagataatagcagtagagataataggaaaattatttaaaagagaaaagaaaaataaagagttcagtcaactaccccacatggtctagaacacgccaaagcttttcgagttcaccaaattgttttcacaccttgtgtttctgttcatggaaaattatcgtaaattgacagaaagtcaagttggttgggaagacctcatcatgactgatgagaattcttgctagcaatcaatgaaaaagcagatgcttatttttcagaacattttagttggaagcagtcaaaacaaaggcatcaatcactagaaaataatgaagtggaaaaccacattacaaaaggatcagaaaatagattattagtagttggagtgattagaaattctgtggatacaaaatctagctgaacttttaacgggagaatttggacaccttgggaggaacaggggagctttcttactatggacaaaagaggcagaggaagtggataatacaagaaaaagaagtgagccaatgtgtgtgttgcacccaagagtttgatctattaaagtggaaagcacttcttatgaagcagagggaggggaatatatggagtttgtctaagacatgaatgctctcaagggaaattggttaaaataccattgtagatttttaagcgggcaagtggaagctaagagaagatattggcaacaatgatgatatataattatattcttcttacagtgggggtttctatgtggaatcaaagtcacatgtagcttgcagtggacacttttttattataaataccatggccacttgaccatctataaatgtggggattgaagctcctgctcaatcactgtcctcagggatccatatgcttccgccatagatgcatcctccaagtccccgctccatgccgctcacttctgagttccaggtcagatggcccttttcatttgcagaatctaaaaaacaaggatttggatttggagaatctaggacatagtagtcatgtatggatgtgagacttgggccgttaagaaggccgagagccaaagaattaatgcttttgaactgtggtgttgaagactcttgagagtcccttagacagcaaggagatcaaaccagtcaatcctaaagggaatcaaccctggatattcattggaaggactgatgctgaagctgaagctctaatacactggccacctgatgcaaagaactgactcactggaaaaaacaccctgatgctgggaaagattgaaggtaggaggagaaggggataactgaagacaagttggttggatggcatcaccgactcaatggacatgagtttggggaagctctgggagatggtgaaggatagggaagcctgttgtgctgcagtccatggggttgcaaagagtcagacacgactgagtgactgaacaacaacaatagaaagatgcaaggaagaatctaagtccccagttatgaagaagtctgtgattacatgttttatggctaattttgtaaaaaattacaagtgtagaaagatggtatagaagtattttatacataacatattcaaaagcagagacattactttgccaacaaaggttcgtctagtcaaggctgtggtttttcctgtggtcatgtatggatgtgagagttggactgtgaagaaggctgagcgccgaagaattgatgcttttgaactgtgatgttggagaagactcttgagagtcccttggactgcaaggagatccaaccagtccattgtgaaggagatcagccctgggatttctttggaaggaatgatgctaaagctgaaactccagtactttggccacctcatgtgaagagttgactcattggaaaagactctgatgctgggagggattgggggcaataggagaaggggatgccagaggatgagatggctggatggcatcactgactcgatggacatgagtctgcgtaactccgggagttggtgaggacagggagg

SEQ ID NO: 64730 - DNA, 1200 bp, Bovine  19866880353588
cactcggagctcactacaatctatgacaagaaaatccattcagaggcgtaactcattggagccctgagccaggatcaaattttttacctccagtactgacccacacgaacaccatcgtaggccatctgtatagtttatgccctgagtgtcaaatgaactgtgtcatttcagggccagctggcatgcccggatttccgggtctccaaggtcccaaaggccgagagggaaatgctgggtttccagggatcccaggcccacctggtcactcctgtgaaagaggtgctccagggataccagggcaaccagggctccctggggctccaggcagtccaggtaagcattggcaggtatcaagaactgcgacaggtatgggatgtatctacttacaaaggaataacctcacttgttcttttgtgggtgctgacaggagcaagactcttgggtcaagacattgttattcacagcacagcaagtagcatgagcttcttgttggtgacattcccccatgtcacccaagtctctctggtgtgatgtaagagcctgggctaccatggctgtatagtaatacattattgatcgggagatgtattaatacatttttagagagtgattacaattaacatcaccatgtgaagttgctagagcttaaaattgatcaagagttcattatacaacttattgtcattatcattcacattatcttgtgttaggtttttgttctagggacgggggagcccagtgggctgctgtctatggggttgcacagagtcggacacgactgaagcgacgcagcagcagcagcagcagtgtatattataaacccaagtttattaccataaaattttaaaaattaatgcattgcaaaaattttgactgaagaagaattttttggtggattttatacagatactttctctgattgtccatgttaaatatatagtattttctcaggagatgatagttgttcagaatatagttctgattcagacaatatgaatattaggccaacaaaaagacaaaaaaccgtagtgattgactctgacgtggcaagtgaaactaaaactcatggtaccaatacatggtacagggtattacaggtgtgtcagatgtaactggggcttctccagtggttcagcgggtaaagaatccacctgcaacgtaggagacacaggagacacgcgggtttgattcctgggtctc

SEQ ID NO: 64731 - DNA, 1930 bp, Bovine  19866880502339
tgggccatgatgccctgcgggtgttgtgcatctcaggcaggtgtgattcccactggctggtgaggttcaggagatagcaggttagagggagggaaagggagaccctcagactcatcgggaaacacctccgacacctcaccatctggtgaggacgttacagatagtgacaaagttatttctgggcattaagaaaagataaactaagcccttgagacattagggaaattaaatgatgcaaattatggagcatggtcgggggggaaacaacatagaaatgggaggattgtcaagtttcaaaatgagtcaaattagcttcatggactggacctcactaacacgtgtactcgatgtcacaatgtcacattgacagctgcagctgaaatgtttgttctgtctctgtttcgtgctaaagataacgcccaagccatttccccccacccttggaatctgggatgcagagccctgtgagtgtcagaacaagggcagtgcttgacgaccttgtgctctctctcttcaggaaatcgcagaagcagccccccggcctatgggttccgtctctcaccagaagaagaaatgaggagacagcggctgcacagattcgatagccagcgaggcgacccagccttgtgaacaaacatggtccagttgtgcagtacttacccccagaccctccgttttgtacaaaagcagagcgggcacatcgccatcccagttgctcacacctgcagtggcctgtcatcctacggccaccatgagtccagttgatgtcttgagctggttgatgtcttgagaccaggcttgttttgacagcccccagctctctgggaatggtacttccgaccttgttctcttgcagacaggagcttgggcgtctccacttggggaccagtctccacgctcccttctctcactgttgactcagtggaggccctgccttgttatgtctttgaagaccttgacctttgccaggaggtttgtgttcaccagcccaaaagatcaggcccccctcctgctcagtgcccaacttggcaggaagtggggagccatccctcatcctcctggcatgttgccatggtgactttccaggcattggatgtagccatcattgcaggatgtcgtcctggcctcccttgcccaggcgcctcggttcctggggcccccacgtctgagtggtgtctgcagtgaacctgcttttctctgatgcccctctgccttcccggatgtgttagtggaaaagcttaagtgagaccttggacaggaaaccagttccacactccacgacccggcaggtggcaccaacaatccagctacaagagcctctccagggatgatgtcacatcctggagatgcaacttgtattgaactaaccagcagagcagcagcaggtgccacatgcagaagagtgaccagcagcttggtcacagagaaatccttcctgaggaagtatttttttttctcataaaagtgccttttaattgaccactgtaacagccaccctccaagacactccccagcacacagaccgcaagtcacttaagacgtctttcctggtgcttgagtttcatgaataaaaggaaaaggtcaaatatcactcatgtcttatgtcactgagatatttatttttaaaaagagttaaaagcagaaaaggatcttcctctatggctttatctagcacttatatagttttctgattatgaaagtaatatatataccttgtatatgcataaagccaacatctgacaggaaatgcacccacatattaacaggttatttgggaaagtggagtgcataggagtttgctttctgtttttcacaattttatattgttctctttttaaaatgtgtgtatatgtatatatgtgtactacttttgcagcagggaaacgatttatataataataaagaagaaatataaatcaggaaaaggact

SEQ ID NO: 64732 - DNA, 799 bp, Bovine  19866880603738
tcattagattgattaaatatgcaaaaatgccaccatagcctctgggtaatgcagaaaatgtgaatacaaatggtgacctcccactgctagaagaataacaagaggaaaaccattgcattcccccaaaggagctgtgagctcgtgtttcctgataagccacaacttcttctcgtctgcgaggtagtgtgtgtatcctcaagcttgattgtgaggaactgagctttttggtctctctgctgtctggttgaagagacctgggttaggctgcctcgtaataatccttgtcattgtttatgcttcctaaatgctttcatgtatgtcacataatcctcaaaacaagctgagagtggtgaagatcattacaactccagccttcttgggccacagaaggaaaacagagaaacttggcgagccaagttcacacagatccagggctgtcgtgtgcagctgggcaggttgtgcacagtgtacaagacttctggttaagagagtgaatggggcctgagacacaaaccctgttctcctcaccacactgtgcagcttggtacaagcttttctacctggaagtaggggcatcctttccaagtttgcagaggaaagagttaaaggccaggggtgtccctgagctggccttgtgtctcttggcctccctctctgattcagtcttgtccaagacagttctcatcctttctatctcttatcctattcagggttctccctgcatctctgactcaacagcctgaaaatactacagtgtttggttatctaggtcctttcattgttcctcagtttttttgca

SEQ ID NO: 64733 - DNA, 828 bp, Bovine  19866880635262
ccatacaaatgagaggtgcttagtgttgaaactacctactctaacatttttaatttaaaaaagaagagcgtgaaaaaataaagatttactacaggcctactaggaaatgtgactagtcaaccatgctctccttttgacctgactatgaggcaggaagtatttgcctcatcaaagatgaggaaattgaggctcagagaggttgaccagcttgcctggattacaagatagccctggagtccagcctgaaactgatttgatgacaccaaagtgcaggcctggtctgtaaatccatgacctcctccttttgcataataaaggaggagcatgtcatgggatgccgagcaatattctacttcaagaaagacttttgagaaatactttcagtatatcctctattctttgggacctcctactttaactgaaaagcaaacaaaatccatttccattagtgtagatgttgtttcatctgacagactctgagtcacaaccctgcagacatcaataaaagagaaaatctctctggcctctttgccaacaggccaatttctttccttaatttataataaaactatgactgcaaaataatgaaagtgaaacttcactatttactgattttgatggctccattctttaaatactcagaaaggacactttactacatttgcacccgcagggaaatgactgtggttggaggttaaagttattcaacaaacaaaaagacaattttgtaaatgtatcttttcctcaaaaatgtaaagcagccaggataatttgtgggttaggcattttctgagagttaatgatcaattatgtgaaaagcccttgaga

SEQ ID NO: 64734 - DNA, 1744 bp, Bovine  19866880786099
gcccagtgcccttgcttcagggaattgtgtatagcagaatttctttgcaattgtggttccaagaacttaaacccattaagaaaccatgctggtgcccctgaggaaaataaaagaaattaagagagggaaggacttctctgagtatagaaaggtttcctgagatgaaataagagtaagagagagaaataagagcaaagtctggagtggggatcagaaaacacatacaccatataacctctctacctgtcctatttcttgggtagaggctcatgggctgtgtccaagcccactggaccctggaaagccccactgaaatccccatgtccccacgtggcctcaagcttagagaccttcagtcactagactctaaggggcccataaaaataaaaataataattttttaaaaaacagtaagactgtcacatcaatcagaaatcaagagccgatgcagcccatggaaatcccagaggattccccaatgaacacatgactaatgaacaatcatccctcatccccaaaagttgctattgcatcaggagagagtgagacatgctctgcgttgtctgagatgaagtttccaccatgtcacatatggcgctagaaacaggaattaaattgagttactagaaaaataaagtcatattttgcacataccaaggcatgtagtctgagatccatactagctacctactcacatgtttgcattcccaatgaaatgctgagctcctagaagatactgaacagacgccttcattcttacagcagtgcctcccagatgttaatgttcacttgtatcatctggatcttgttaaaacacagattctgattcagtaaatctggggtggcccaagattcttcattcctaacaaattctcagatgccactggtcgtgagtagcaaagccacagagattcataatgacctacacatgtaatagatgctggagtgaaggcaagaacaaagaaacaagtgaatgacgattgaataacttgaattacagaatgtgctgattctatttgcctttcacatttttacttctgctctcagaataggaaggtatgacatgtgtacaacactacgctaaatgaattcatgcagacatgttaaaattatcactcttctagtccctggtgtttcagatgataaagaatctgcttataatgcagaagatccaggttcaatccttgggtcaggaatatctcctggagaagagaatggctacccactccagtattcttgcctggagaatccccagggacagaggagcctgaagggctacagtccatggtgtcacaaagagtcagacacgactgagctcacatgacaaggctgtatattgtcaccttgtttatttaacctatatgcagagtacatcatgtgaaatgctggcctggatgaatcataagttggaatcaagattgttgggagaaatgtcaacaacttcagatatgcagatgataccactccaatggcagaaagtgaggagaggatcttgatgaaggtaaaacaggagagtgaaaaagctggcttaaaactcaacattcaaaaaactaagatcatggaatccaatcctatcacttaatggcaaatagatggggaaacagtggaaatagtgacagactttattttcttgggctccaaaatcactgaggatggtgactgcggccataaaatttaaagactcttgctccttgagggaaaaactatgacaaacctagttcagtccagtttagtcactcagttg

SEQ ID NO: 64735 - DNA, 1506 bp, Bovine  19866880801639
ccctgggattctccaggcaagaacactggaagtgggttgccatttccttctccaatgcatgaaagtgaaaagtgaaagtgaagtcgcttagtcatgtccgaacctcagcgaccccatggactgcagcctaccaggctcctccaacccatgggattttccaggcaagagtactggagtggggtgaatatatacactaccatgagaaaaatggatggctagtgggaagctgctatacagcacctggagctcagcttagtgctctgtgatgacctagagggatgggatggtggtggagtggtgggaggaaggcttgaaagggaagagatacacgtatacaaatagctgatttactctgttacacagcagaaaataacacaatattgcaaagcaactataccccaactaaaaaaaaaaaaggcacatgaaaaggtgctcaacaggttcattattagagaaatgcaaatcaaaactacaatgacgatcacctcatacctgtcagaatggccatcaaccaaaaaaaaaaaaaaaaaatctgcaaacaataaaggctggagagggtgtggagaaagggtggtgtcggtgggaaagagcccggattttattctcactgtggttgggcagctccttgaagacatgatcccctggcttgtactcggcattctgtctgccattatgtttgcctcctggagagatgctgcccaggatgtaagactgcagattgctgtgaaaggtagagatgaagggaaggaaggaggatgggaggggagaaaggaaagagagctggagggaaggaaggaggagggtcagagtacagacatccatacagccaaccatccatacgtgcaatttaatgcttctctccattgtcaggggctccaggaaacaccaaggccagcgctagtgggtggggaaatcttccatcctcctgtgaacatttggtgtcaccctggtccctttccttgcatggtcctagatggtggtgggggctcaggagcctggagatcggtgaggagcaccgctcatcactgcccctgactcccattgctggcagttctgtctctcaggtcacagataacaactgtcagatggtctccctatgaagcaataagcttccccaaaacaaagaggccagccaagctccaggaaagctgcagtctggacaaaacacaccagcctggaaaaaattaagagttcatgagcaactgaacaaaggacctccgggaaatgcaatgggttaaacacgagcacacagtgttcctgacgcccttgaacgcacaaggagaaaaatcatcacacatccctggtaaagggaaaaagaaaccacaagagaaacaagtcagtgttgtcgcaggagaactaaaaataatgccgtgagaggttgggccagcccagaaatgaagggaaagagatgataggcagtaggggaagatgagaaatgagtcagggcgagggggccatagcctggcccttttgtcttttaaagagcgctcccttcacagcctcggt

SEQ ID NO: 64736 - DNA, 2051 bp, Bovine  19866880837218
tccctctgttgtgaatcatgatactatatgatccctaaggaatttttgaaactttcagtacttttcatctgcttcaaaaagatcaattcacaaatgtaaaatataataattacaacatgcattaaaataatatatgcaaaacagacatttaaaaaatgatattttgaaatactttataaaaataaattagatagcataagggatataagctattattagattgtactcaaataggctcacttttttacctttgggccaagaaatccaaatgacccaggatctccaaacagtcctggttccccctacaagtaacaaaaagcatgccctttttaaaaaaaaaaatgtgattatgacattttatctcattgacaaattatctcattctcattttatctgaatgacacatgctccctgagattctatataaaatcttaacactgttttaggttgcatcagagagttttgtgctctagtttttgcacccacagcaaaattatataatttataaaataaatgtgtttcctctactgtgtatgagtctgtatgtcctggtgcaacttttgaatgatactgaattgcatctactaatgaaaatgtatttatcatctctgtaatggtatacatttacctttaatcctggaaaacctggagatccataggaaccagggtccccctaataaattcacaaaaatcaacgcaagcaaagttaaataaaaatacataaaccaattcagtaaatcatttttccccttatgagattgcttttgggatttttaatcatgcctacaaagataactgaataaaggaaataaacataaaagagattccatttctttacaacatttgctattttaattactctttaatattattaaaaaaaatcatgtcctctccagtgatataaattaagaatatagttttgttgtttgtattgctcttccactttaatttatttaatgtaatgctttcactgagctaaatatctttgaatcattgcaatataatttgtctggagattaatagttgctctatgcattatcagcaataaaaattactattggaagttaatattgcctcattaagtactaaatctggagtcaaataaactcagtgtccatggctgttggggtctggccttcatcgtgactctgtgaatggggatcccattagtgacaggtatgggagatgttgaggcctgatgctgtactttttttttctagctactatccatagaccagtactttcttttgtcaaataggcttaactgaacaattccaagctacaatcacactgacactgagccagtgagaaaatgtcatgatcccatttttgttattggttagctctaagttgtgtacaactctttgcaactccatggactgcagcacgccaggcttccctgtccttcactacctcccagagtttgctcaaactcatgtccattcagtcgaggatgccatccaaccatctcatcctctgtcgtccccttctcctcctgccttcaatctttcccagcatcagggtcttttccagtgagtcagctctttgcatcaggtggccagaatattagagtttcagctttagcatcagtccttccaatgaatattcagggctgatttcctttaggtttgactggtttgatttccttgttgtccaagggactctcaagagtcttcttcagcaccacagtttgaaagcatcgatgcttcggtgctcagccttcattatggccccactctcatatccatatatgactactggaaaaaccatagctttgtgtatatgggactttgtcggcaaagtgatgtctctgctttttaatatgctgtctaggtttgtcatagcttttggaacatgttaaatatcataaatgctattagcaaaatccagaccgtgagaaactacaaagtacaaatgacctaggtttcttcaacaatagcaaaaaactgcaaagggtgtaggggaggtgaagggagtagaatccaaatctataacatctctccatagatttaaagagacctaagaaacatgcatgggcttcccagatggcg

SEQ ID NO: 64737 - DNA, 681 bp, Bovine  19866880877559
atataccttgagctgggtgctgctctaagctcttcctatgtattaactgaattaggattcaccgtaactttctggaagtcctactgatgttcctatttttcagatgagaaaaccaaggcacagaggggctcagtaacctgtccacttacagaaggtcacagagtgtaaactgggtctcaaactctggttcttaaagcccccagctgtccttcccctttcacttaagcagttcttaacacttgttttacaataagtctcagactaatcaatgagaagacagcatccttaaccatcccagctattctttctgcttttccagtaaacttgcagaattcttttccttatccttgctacagtccttctgaagtagtgatatattgactatttcatccaaaggctaaaccaagactaacgcctaagcaaggaagaacaaatagtgaattcattaactgggaatctatttacaatccccagggctcattgtgcgggcagtgcttctgtatcatttagagttgctaataaatgaaagtctttgcatctttccaagcatcttgatatttaccagtctcatattttaccataggaagcggcttcaacaagcatattcatgtgttgacagttctaattaatacaagtaattagtcctgacagtagaactgtaaaaagaagacccattcataa

SEQ ID NO: 64738 - DNA, 999 bp, Bovine  19866880889948
ttgctgtaaagatatggcatattgcagatagtctaaaatcctgagtggtggttcatcatggcaaggcgttctgtctctagtctttgtattattttcacggtgtttatttccttctgggacgcttgtctctgtgaagcccccactggtttcaggtctgttcagttgactctgtagggtggaggatacacacaggttctgagaattgccttcagttctgttccctgatggagaagcacttgaggcaaagcagcaaacaagaagggaggaactagtgcagctctactggatagacatattggctgacgcagggtcccacgaataaatgacatttctgcatttttcaaacatgttttggatggagattacatgtagctaatgaaattcataagaaaagactatgagacataatgtaggggatatggtttgatcccttgtcagggaactaagatcccacatgcctcagggccaaaaaaccaaaacagaaaacagaagcaatgttgtaacaaattcaataaagacgttaaaaatggcccacatcaaaaaaatctttaaaaataaaagatgtaacacacataactttctgtatttgaggcataacacacatgcctgaagaacgtatgctgtatatgtctgtaaaaaatctaggttaaacattttaaattacacgtgctattaattacttctggaatcactggctttctgcatgtgtttctgtagcctacgatgacaatgagagctttgtgttcatggcctttcaaagactgatgattgacttgtgatgcaaatgttcctagggtgatcacgaggatgcagccccaggtgataaagggcctcctggaccgccagggccccctggcagagcgggacctagggggcccccaggcctgggatttcctggccctccaggagacagagggcaaccaggagctccaggctacccaggcaacaggggtcctgatggtcggaagggtcggaaaggtaactgaatgaactttcttg

SEQ ID NO: 64739 - DNA, 1217 bp, Bovine  19866880892307
aaacgggagatgtttccagccctgcgtacagctgcggggacacccgagggaaaacttcactgcatcaggctctggttgggtcacttgtcaggtgaggctgaggagcaaggtgactgccagggtccttgctacaactctggagtttgacgactggaattcaattgtgcctcctccatgtatggttatatatccttgagcaaggttactggccctcagcctcagtattcttatctataaaatgggaatagtaacagtacctcctctgttgggttgttgagaggataagaagagatgatgcatataaaacgctgagtgccaagcatgcagttagtgcctgatggccaatggccgctgggacttttaactgtaacatcagtgagaatcacgggttaaatgtctgcttgttactatcactgacaaagacagatataaaataaaattaccaatgacttcttaaaagataagagcccaggaagtctctggtggtccagtggttgagaatctacctgccaatgcaggggacacaggttcgattcctggtccaggaagacccacatgccaggagcaaccaagcctgtgtgccacaactattgagcctgtgctctagaacctatgttccgcaacaatagaagtcactgcaacgagaagaccatgcactgcaactaaagagtagcccctgctagccacaactagagaaagcctgtgtgcagtagcgcagacccagtgtagtcaaaaatacatacaaaattttttaaaagatagagcctaattctgtttgaggaacaactgggagtgttttgtacaaagtgtggggtcactacttattaaatatttgcccttcaagaaacagatacaaaaagggtaattcgtgagccccacttttgtaaccagaaggagccttacaggctttgggaaagttggcgaccttcttttctctgctgagtaaaaccatgcattgaacgtttacagacttaggtgaagtggcctcgctctgatgaacttggtacagaatattagtatttatgagccttgcttctgtgctcctgtaaatggaggtcagccctcaattttactgaaagaaagagtgagcatgcttcaaagaacctcaggaacagtgcctggtttaagaagatttagctcaattatggcaccaatggtgagatcataagatttattgacttgtggttcttgaggaaaaatgttcagttctctacggt

SEQ ID NO: 64740 - DNA, 1803 bp, Bovine  19866881231784
acacacaaacacacacaggagcttccatctctattttcaagtaacagtttggtcaaatagaacccagctaccctggctgatttggacttaactttctttctgatttctagtatcagcaaagctaagcataagctgtaattaagagaaaaaagcaggaaccgaggagacaaagtagaaatggaaaattaattaagcttaagtgaaattagtttcgcttaatagacacacacaccagccagcaacagtaagcttatggtgctattgatgtgaattcataagcccttaaaaagtctctagttaagattctgcctttgaaaatgtttcttatcttcagtcgccacagcttgatgaaacatcataaagcaaagtcatcctcttgttgacttaagggtctcacaacatcatgatcatctcctaacatgaaagaaggagtgaaagggaaagtgaagttcagtcatgtctgactttttgtgacctcatggactgtagcccaccaggctcctccatccatgggattttccaggcaagagtactggagtgggttgccgtttccttctccaggagatcttcccagcccagggattgaacccggatctcctgcattgtaggcagacgctttaccctctgagtcacccatcaaaaggtgaactgctgcatctgccgaaaatgccacagtaaccactgtatcatctcccatccccaaggacatccccagcccataacaatttttaagtgattaaaatagaaggcctttgtgaaatgtttaaactttaatgactcaggttttaaatatgctaggaacaagctgtaatttttcttgtaatgaatggtcaattttcttctcaaagcttaaattctgtggggcatttgaatacagtgtacattctcatctaaaataagcatttttgttcttcacaagatctagaattaaaaaaaaaactcatttgtgcgtctgagtaatgtagtctatagtgcatctgagtcatctacagtctattagactgatgtttaagtgttcactatttatgtttaaaatctgtgaaaattctataaagacttcacattcattgacatgcagaaaagcaagattatttcttagaaataaacaacaacaacaacaacaaaataagcagcattttttctctcttggttcctttaaaaagagtagtaggtttgtcctcttatatcttaccaataggtaattttttacatttatattttaactataaaccacttttacttatgtctaattggtaacatatatctaaaaagtaatccgatgagagggcttgtgttctgagcacccacctgattttgaaacatatttggaattaatgttgaacaacagatttcaacagcatcatatttgcatttagtgctaaataattctcaagtgtgggaagctgaccttgaatttttaaggatgttcagcaacatccttggtccctgctcattacatacagtgtaatccccccacccagttgtgaccaccaaaaacatcttcagacattgccagatgtcccttgtggtggtaggcaggaaggggtggggagggtcaccccctggttaatcaccaccaccctatggcccttgctaaattgtgcttgctctggaaatgatccaagctcctctttctcgcttgaataaaattaaaatgtttgaagatatggttctcccttgcccaaagctgttattgaggctcacagcatacttgtcaatatcagctagtatatgctgcttcgtggtagaaaatgctatcttctcagtgatggggaaaaaagcatgcatgggttttcaactgat

SEQ ID NO: 64741 - DNA, 937 bp, Bovine  19866881279117
gtgagacagtcagaaaaaagcttatccctggagctaacggctccatatacaattatattccggcaagtgtggctttgatgtatgtaattctttagtaagtatgaataacttcttaggttatttagcccaagtgtttcttaagcactgttcagtttactggagacatttcatacagattttcagcagatgctggcaaatctaaatatttgttcagttcttgagattgtttgctgaggacagtactttgtatttttagataactgcgtttgattacatgtgaccttattttgttgcaaccaattgtttggtgttctcaaatttgtctgagatcagtacagtgagaactttttcgttgtcttttccattttaatcctttccttcatctgataattaccattgtctaaagaactacaaaaagggccacagtaaaacaagacacacatggggatcgctttttaaaaaaaactaatttggaccactgatttaattatcccgtcaaataagcgttccccctgagttggaggcagcgtctttccaaaccccatcttcaggcacgggggcacagctgcatcttggtaggagacacgcacttcagtgtcaggagacagctgagttttcacaggtcccccaagaaccatatggaaaacagcccagtgtttacacctcagttccagagaaaagccctgtgcggttatgactgtctgacagctgcagagactgaggcacgaacgagtaagtggcttccttcggggacaactgagacacgcaataaatgacctctgctgatgtctggactgggtgagcctgtcgcccaggtagcagtctaggcagcccacagctctgttcccaggacccctcagagttcctgggacaatgcaaattcttgatttaggtgttttttttttttttttttttcctatggcaaaatactccccca

SEQ ID NO: 64742 - DNA, 689 bp, Bovine  19866881337018
tttataggcttctttctattttccaccttctctggttctaattcaagctgggttagaagggatgtttgaatatctatttaattttaactgaatcctctattgtttttcttcaaacccctctagagcagctagtaatataacttgaaacactccgacaccatctaaatagaggcaactgtaacttgttctgataataattgctcagagtttaatggtatattacccagaccattcacttgatttctcatataatcttcaggaatttcatctgtagtgtcagaactaagtgtatctttatgcctcctctagttacttgctataaattggatatttaccagtgagcaataaacatctattctattcagggacatgatggcaaatgagagcaaagttgcttcagaaataaagatgagacttggacgacaaccaaagcttcaggttctgttgacacatgtgttcaggtcatttctatctttttttattttattttgttgatgtcatttttggttgcactgggtcttcattgcttcttgtggacttctcgtgggcttctcattgcagtggcttctcttgtgtcagagcacaggctctcggctcgtgtgcttcagtagttggagcacacagccttattccacaaggcatgtggggtcttcttggcccagggatggaaccccgtgtcccctgcattg

SEQ ID NO: 64743 - DNA, 1057 bp, Bovine  19866881816957
tgccccgttgtgttgaaaagataaattgcatggatattgttcgcagtcaaggaacaaccaattaaacatctttcttccccctctccattttttccttcttcctagaggactgaaatcctttggaaatgtcagcaggtaaggacatctcctaatacgtgttctgatcctcactggtcttgataaaatgtttaaggtatttccacaatgtgtagagtttagtttgtaactaaaaggcaagacctgaggagctgagaatttctgtgtctgtggacttttaggattaaaaactaatcctaaagtatttaaactatttacagtcacacctttgtttggaaatagtaattgttatgatctaggcaatggagtattacctagttccatatatacaggtaaataagttaaggaacttttccccacattgaagaactttgagcctggtaatacgtatttatgatatattcgatgaataccctccttgcaacaacagcaatcagattaacttgagaaacgaaaacacaacaaaaataggaaaagaatagaatcattcttctaagcccatcttgcacattatctcatttttctttgtattttggggtcaaaattatagtggcagctgtaatagcaccctgtactgatcggggcaactcagtcagaaaagtttaagttaagggatcgtttattcctcagaaactttaaaataatagctttccatttcaagaggacttagaccaaccattcttaaattctgttgatgcactttttgttgttgtttttttagagtgatgaagggcccagagccgaggaagaaattccattgctattctcagatgtatatagccaaacatggataaaaacaaggaaacttttatagcactgtatattgttgaagtcctcttggttaaaaatggaataaaacaaaacaaaacaaaaacattgtgggcagcctcttttccttgatgcagacctatcgggtagggctggatgatttttcttggtctctttcccaggttgttttaatgcactgtgaatgatattaaatggacccatggtgaaagtg

SEQ ID NO: 64744 - DNA, 1057 bp, Bovine  19866881839607
ctaatagcgtgcttctttcaaggaaccacattcttctatagaaaataaggtaatgctgttaaaagattaaaggagagagatctccaatgcagcttactcttgtccctgctctcaactttccttccttaaatccgatcatctgcttttgtaaaaggaaccataaaataacatccacgtctgagtatcagggagaagatttatcctttccttgggcataatccactctcctccaattgagttagcatctggccaaccggctgcagggatttggtgccacgacacatccccaggcaaggttttttaattccccactgcagcgaccctcaaataacgcagggtcaccactcccctccccagagtgaggcacgaggtctcagcacgtgatttcatcaccaaagcaaatgcatgtatttttttttaatccctgcattttatttatccccacaaaataactaacaaatctctgtttcctaaaggttctttgttctattcagagttacagcaaccttttataaaatgcacacaaagatttttttttcccccacaaatgggacatttcagagaaggatgcccatttgtttgtttgtgtttctgtctgtctgctttaatctcaattttgtttaatcagtacaacatgttaggacttctgttagaccaagttctaatctaaacacagctatttagaaaaactgctttcttttacatggacagcaaagcaagaacaggtttgtcaaagtacagggtgtggaaaggatatctgctccctcgtggagttctgagtccaactccatcagcatttctctcccaccaaacatccctcctcccactgttcgcagcaaataaggatttgggtgagttaggtctgttcctgcaggtagtcaacctgtctggaacgtcaaaagcaaaatcatctgtgatgtaaacatttttcagacaaagtaaggctgtcttttttttttttttaactcaaaagacaagctaaggcatctcactgtgtttgatgctttatgacatgtgccataaagagcaaagcacataaaaaaaaaaaaaaaaaaca

SEQ ID NO: 64745 - DNA, 1647 bp, Bovine  19866881855044
cttagtgtgtatgcccagcagtgggattgctggatcattaacttgtatgaaaggaaagatggtagcttcatgcagccagggctgggagagaaagggaagcagtgaagtatgcaagaacacatgtaaccattgaaatcgctaattaacaattcctaattagcctgaactgttaacgctttgtccgaaggagagtggccacttgtctctgtcattacagggactgattacaagttctgttccacatgaacttagatgcagggaactctggtcctgctttgagttctctccttgcttacattttgtgataaggtgcttctggcatattcatctaaaatgcaacacgcatgttctttcttccccagtagtgctgggatagggaacataaaaggcataccttgtgtttgagtgccagttgacacctctgtggagttagcttcgtagcagtctgttggacttttgccttgggaattaggaatgaggttgaggaataacaatttggaagatgatggttacattgtctcctgtcccacatgttcttctagaacttcacttagagatggggtctggagctcctccccctgaattgagtgggtttgtggctcattgcagtcaatagatggcagcagaaatgccatgttacttctgaagcaagaagtcctttgccttatgagtggcaacactggcccgtggagcccacattccctggttcccccatgctgtgagcaagcagcacacaacacgtgagtgaaaggctgttagaaatagccgtgtgtcagcccagcctcaacatggtgggggcgacaccagccacccgtgtgcttcctgaattcctgacccacagaatctgcaagtggaagaaagcaagtgttattttatgcctctgcatgtggggagatttgtcctgtgtaatgccagacaggtgaatgaaaaagaagtggggaaagtataatgaaaagcagaggagtacaaaggacagtatgggagagagtctggagtgaaggtggaagagagccaaggagggcagcttggggaggaatgcatgctgggatgctgtggtaccgtgggtcacgacagcatcacccatcaggtaacagggctttaaagcagcggttggcacttgggggttctaatcctttaaagggttctgaaatcagtgtagtgagacccaagcagcgtttgaaagagagagaaaggaagagaggaaggaaggaagggagagaggaaagaaaagagaaagacagaccagtgttgaatgtggtaagggtgttatttccaggtacttttgttttaggtgtatgtgtgctgcatttctaaagtgtatttttagtgtgggacagtacaaaaatttggggaggtgctgctttaaagcagctattagttgcttaaactagagttaaatgcatttactctaaggtccgggacatttattgtcttcagtggaagagctttagattgccgggtcttgagggacgatgagaataggctgtgatgacagatttctgccaatttattgtttttcattagaataagtagtaattcacaagacttattaattaataatcatgccagctctccagatagctgtctatatggatatgtgtgctcacagatttagacttcacctacctaaatcagaattgctagtaa

SEQ ID NO: 64746 - DNA, 1307 bp, Bovine  19866880414592
tttctaccttctgttgtgaaatgctggtaattccctaggtacgtcaggaactagcccgtatcagtgcctctgccagggtcttccttctcacggatgccgagtccctcttgtccacttgacaacctcctgtgattctttaaagtctcaggctctcagagggctcttttttaggggaacgctcaggacatgaaggcgatcttgttattttcctgcagggactccactgctgttcctcgtgtcccacaggtggtgttggggcccaaagtctcccccatcattagttttaagccatacttcacagtgaccttaataaaaatttaaagaccatataacatacattatccggtaggtgtgttaattagtcttatatatgacatcatctctgctcctgggattttttatggctgtcatatatctcaaaggaaagacttagccattctcgacataactacataaaattctgtttcgtttgccaggcatgacaaaggaaatatatcttctgaaacatcaccatgtattttgaacagtgcaataattagagaacaatatttggagaatattatctctctctaataaatatataaactttcgattattacttttcataattaaagctgatgtgccatcatttcaatgatgctttagtgtgtcgttttaaaacatttttaatattttgaacaatctctaaaatgtatgtataagcacaactttaaacatacatataatgttgtcaatttttgcctttaactcaccatgccagtcctctgaaaaagtctgccagtcttcctgatattcgtttggtatatagatttaagaaatgtagctgagtctttccagtttctcttagcatctagcagtttatgacagcagcccttactcttcaaacccgtattgaattgtcttgaaaggaaggcaatagaatggattggaaatttagaatattttttgaaaaatcactcgagcattatttcagatagtctgagtagcgtctttagaaatgcgtgcatttaacaaccatagatttagtgtgtactgtgtccaaaaaatagggtcatgtaaaattaaaaatatatcatatttttcatctggttcatatcagtttgattggttttttctgtttccattgtaaattcctcaaggcaaagaaagaactgtctctatcctgttggtgtgaaccttcttgtagcaccttgagtgtattaaacgtcatgctttcccaaaggcaggcagataatttaaccaacagaataaatgtacttctcctactttccattagaattttaacataggtcttcattctcccaaga

SEQ ID NO: 64747 - DNA, 2934 bp, Bovine  19866880491960
tgtgggagcgattccaggagtttatacacaaacttgggtgattttgccaagctcctctctctccttaatgtccctgcttcaccccactttccctgaggcttgctattttagtgctcccaccagaaagctagggctttgttttcctgctctttcccacaggaagcatcctcatctacaaaccaagtggtagggagacaggggaggcaaagagcaatggaagttctctccacaccctcttgggaccagttggagaggaagcctcatctccctccgagtatcagtggtctgaagcgccctggttccttcgctaacactgcattgccaccgcccgttcagtgattacctaggcactggggctcaagacagtagagatatttttcaaaagagatggatttcctgctccctctgagcatccctcttcctgcccctcaagccagggctggagggcttcttttggagttttgtctgcatgaatgaccaccttgtgttttgagctgtcttgagttgtgggttagaggaagataaaatgctgataaactcaccaaagtttcagagactctgaattcggctctttttccccagtttgcttgctactgctactttcagaggcttccatttgcttctccaggcatagcttccctgtgcattctactgagcttctgtagcttcattcagtggaagagacaggctggaggaatgtgtgtccaccctggaattgaaacccttgccgcctatgttttcaggttaatccttggaggtgtatattactatggatggaatttgggtagggatgtcagatttgacacagaatttttctctgacactagttgtgtaaacagacatgctagttggcttctcttgagtcttacttcccctccttgttaagtgggaagtcaatgcatgtcaccgatgtccagttccagaaggtaacgtgctaagtgcctgacatagaccaggtgcttcatttctatccatttataccctgtggctcagacagtaaagcatctgcctgcagtgctggagacccggctttgatcgttgggtcaagaagattccctggagaaggaaatggcaacccactccagtactcttacctggaaaatcccatggacagaggagccttgtaggttacagtccaaggagttgcaaagagtcggacatgactgagcgactttacttacttacttacttatagccttctctcctcttctttcccctccaaagctgctctcctaaaggcatggtgggggaaatatttggagtgtgaagagcctattcaacctgattttgccacatcttgtgaccagaagtggttaaaaggggaaaagagtccgtggctggaatagaaaagaatccatggctacataagcttcaggcaactttaaacatgagaacctatgtttctatgcaaacagggcatgaagagttttaaaaacagcataaaggcatcaagggagaaaggctgagatgcttctgttctgtttaataaatatgtcattagaagatttgtattaatataccaccactgctattgacatttcattataaacgctttagatatgacatcaagaaattacaatatacatatttaaaagcctagccttacattttcagcactggagataaagtgggatataataggatctgatcaatcatttagctgacttaaaaaaaaaaaaggcaaccattacttttaggagacagcactggagtggtatattttaataaacaaaaatgctatgagaatcttaagttgaagtgtccaaacgctaaatggaaatcctgcagggttaagacagagccttatcttacccaccggcgagacggccttttttaaggaccattctcgaagcagcaccatgcactctggggctgttttcagtgttgagtgcaatgtgggagcgtttggcacggggtcttccttcctttgagatcccgggggggggatgtgttctcgggtttcagtaaaagcaagggctgggcatctcctgagtgaccaccctatctcccttcatcacctccatgaatcacaacgctcagatccaaattcacagcctgcctctgttcaggagacaacgcgtggcacgcattcatgcactgtgtgtgctgaccttggggccggttctgtttgcttgtttgtcaggagcacacgttcactcaccctatttgagaagaagagacttgggaaagaactgctctcctgatctctagtctcgccccttcctcacagctgccaagatgcttgttctacagaatctgtctaaggctgtcatgcttcggcggagaaagtcttcattatccccctgctgttcaagacactgggagccagaggggtgcagcagctgggagtgtgcactcgagctgccccagccgagcttccaatccagatccaccccagcgtgcctcgggaagctggcccaactctcagagttaacgctgtggcccctctagcatcttctcccacttgtccttttagcttaggtctgcctgggatatctcagcccatcccaatctgagtattcttttcttcttatacagctgtatgatatttcctccccctcaaattcctacaaactgtttctcccaccaaaaatgccctcctcttctccagttcaaaacactgaagctggccttcgagtgataacctgcacactctccagtggtctggaatctcctcttccctcactcttttctgtagcagtttgtctctgcaattcctctactaatacatttatcttatcaatttgataaacagttggttaccatttccagctatacaaggggttggataaattttagggggggaatgttaaaacattaaaatgaaacatattattttgctcctgatagagctttacagtcgagaaggagaaaggcaaaaatttggagtccaggagagaacccaaatgccataatgaaatagtcagtgtcaca

SEQ ID NO: 64748 - DNA, 1404 bp, Bovine  19866880503357
cttgaactttagcatttccgacctccaggactatgagatagtaaatctgggttgttttaagccacacagtttggcagtttattccattaacagtaaatatgatactgtttgttgagttgtgcctgtattgagtaattgacattcatttattaaaaaaaaaaatgtttgctgagtaagcatgatgttccagaaattgtgccaacttctgagggtacagcagtggcccaaacagtgaggagctaatttatagtccagtgagtataaaaataagaaaacagctcaataagctcagtattgctacacccattctagagacaagcaatgaaggcaaagaggagtaaactaacctcttcaaagtctctgaattataggtggcctggacaagctcatctgtctcacaaaaatcagtgccatttccatcactttcccactttccttagggacagttcaatgatgcagatctaaaattctttcacacacataaccctcttatattcttctaaattccctgaggagtgcatacatgctttcctcggatgggacaggggccatttctaaagctgttttgaagcatagcacttctcaacttccttctcctttggaccacagtcatgtaccttgttataggcaacccctaatattttgattattttgatgcaaatccatcacccataataaattcacctgctttccaaatgcaatagattttagaagcacgaaagcaaaaactaagtaagccctgacagtctttgcaagtgtccgtgacaggagagacctaagtggctgaaagctgttttcctcactgccaatctgccagatgattttccttgcacaaacacatacccatccggtcgggctaatgcttgccttttcaacatatgtgagcaaataaatgtaattacgagcaagatgtaatcacaattgctttgctattaaagctgctgtacactctcatggcttggttaacaatatatgcagaagggtggaattgccttctactctcccaggaagaaaaacatgccagaagtatggcctcttttatattatatctgcgaaaatacaatatttaaatgcagaatttgactttccaagaaccgcaccagaaaaccttttaacggaaacagcagggagaggaagctttttaaatcatgatactccatgaaggattatgagaatggaggtcatcgcatgagacggaattgcaaatacaatgaggaaaatctttttcctctgtgtaaatacacggggacaatttattcttctctgttgagctatcagggaatattttcagcttctggaaaaagaaaaggaaagaagccaccgtgtccaaatggatctattgagtgatgtgcttggctggtacctcataagaatggtcggcttcttacatactgaaccaggctg

SEQ ID NO: 64749 - DNA, 4506 bp, Bovine  19866880503575
ggtggagactttgaagatattgctagaaagcattctgaagataccaacggtatgcagtgacctgttgctccagaagcaagttcatgggtgtggtactttgcactctgtttattgaggttggtcaatgggtctgatagagattccaggagtggaggccgatagggcaaagggacaagacacctggagtcagaactcctggctcgtgctcaagcgttgactaaacttcctggtgtcaatctcttcatttttagaaacaggtggagatgatatgaacaagcttttctctagccttatttcacccagggctcacagcagcagctctgagcaagtgtcttgtgccttcagggcctttgggtgggcctcatcattctggtgataaagccccggacttcagagtagcccgtggggcctcttctgggaactctcatccccctccttctgctgctgctgctgtcctcggggccccgtttgtcacggggccgccatccctggggtgacacccaggcccactttgcctgccaggccctcctctcccccgattctcgtccctgcggtcctttcctggggacagctctagtggccttcgcgggcctgtccccttctgggcatgtcttcttcgccacaccactcttatagtcacacttttgtgtttgtttgtgaattagcctttaagaaaagatgaatgatgaactccatgaggtctaggatcatgttgggttgtggtggtcattttattcctaaactgagagtgtgtgataaaggcaaacacttggatgaaggacaggaccgatgaagggagggattgagagagagagggattgaagggaggcgtggcgatcctggacgcagccgacttttctctgaaaaggcctctgtagtcagttactagtcggtgggcgggtcaggtgtgagcccaaggcagtgtggctcctctgaagcccttccagttccccaaggccgaatcctcatggaagccccattctggtacttgaatcccaaaagaagattccgtactttctgagctctggccaccagaccatgtacattatttattgcttaggactgagggcttgttcagcgctcaccccccactcttttatgacatactttctggatcaaactgtaaaccagcagagaatgcttagcaatcattaacagctgttcttggaaaaggactagatcacataattgtaccttttacaacatgcaccctgatcgctgttccacctccgtggccatgcatgtcctctggagctggaagcatcgcaaacaagtcaggagcaagaaggtggggaggaagacccaagaaacaattgactcattataaagttgctgagaagcttagggctgcggcattccggttggctgctaagtgaatatgtaactactttatatatttcaacaaaattaaacttaaacctacagaattaggtttattaatttctgtcaaggctcaatgggggaataagaatggccattcattatggacacacaattactggagacaaaaatgaagcccagcactattaagtataataaaaatgttgaacactgaggaaattttcattaaatataatctattctttatattactacacttaatccttgctgtctgcttctctgtttttctccaacctatttaattttattacttaactttttataaatgtgttcttaatataattatgattaaatatttgggaggagaatgttagtctcttaaaaaagagaaggaaagaagtctccttccatgtcctcttctcttcactcctacgatggtgaaaaatgatgtttttttggaaaaagcaagtgctaagtgggattttattgttggggcaaggccggagcatgagaggagggacggcaataaatatgaaagaagctctgatcagcagttgtaggagagctctttatattacacatttaaataaaagtccattgccttactaaaaatgtctgtgaatatttgcatggccaaaccatgtaattaaaagatgggcccagctaatgttattgcttgcactacaagaaaacatttgtgatcctagtgtttatttattttttaagtcacgatgtgttcttgtgtgaattgcccccttttattaggtgctaggggtggattgtgggaagcgaaatggggaatttcattttctttgccaaaatatggctgtgtcacccgtgtctccaagcttcttcttggagctatcatgatcttacgtatttttcttagcacagctcaagcaagaagaagccatcaatgcaagtgtggcaaataggggttattgaaataaaaccaggactcaaccttcatccacttacaactgctttaatgacttgtgttcagaacagaagggtcttggttccacagccatgtcatttggggagctcagttctgggcaccatatgttcggttttaagactagtccattttctgttttcttccagttaagtaagatgagaatcgagttttcattcatagcaatcacacaaccctgcccaacttccagggcctactacatgtattcttatttcccagacccgtcctcccaagaggcttatgtgtacctctgctcagccagatatttgacatttacggggtaatgactgtgcaaactcgtctcagagctggggcctgatgttcagtatgctgcctttttcgctcagggctttgtttctttggaagctgacagtgctcgtcatcattgttggtgctgctattattagtttgcacagttcatgacataattagtcttcccccatccttctcaccactggtgtaaatcctctcaaactaggatactctatcgatatcattttcttggaaaatgctctctaagctttctgacctggtccagcctgggttggtggctcacatgacggctccccgctgtggtcttgggatctcctttctccgctgttctaagcgtcctttctgcctctcattctgtgtctctgtttcctaggcctgtgccctcctcctgattgctccccatgttttgtagagcatgcgtgcctgagtgctaagttacttcagtcctatctgactctttgtgaccttgtgaactgtagtccgccagactcctctgtccatgggattctcctggcaagaatactggaatgggttgccatgccctcctccaggagatcttcccaacccaggaatagaacctgcatctcctgtatcacctgcactgcaggcggattctttaatgctgagcccccagggaagccctgttttgcagagcatatcttcttgtaactttcaaagatggaaagcatgggatttaaactccaggaacttgcctgttagggaaatcttctctcccagcactacccctgtttctctctagaacctcagcttatcttagtgctctgcatagtctttatgtgaaccgacagttgacagtcttcattcttactcactggcttacattagtttttggcatcccccgtaagaaagtaaggtcatgagtagtggggacttcatctgtttcgctcactgctgagtctcagtgccaagaacaataacagatctattagacactcaataaatgttcattggataaaggaattgatgaatttattagcttgcttaaacatatgaatcaacacagaacaggaggtgctggaaaaggctagccctcactcgacatagctcatcgttaggcagagggctgaagtgattctgtgtgaacaagaatatacgtcagcctttagaaacgaagtctccatcggagccttccgcggggccccctgctgctggcacctccagcacgtggctcccctttgagcaacgacacagaaaacctggacttcaggcacttgctggaggggtttgccattgtcctcctgccaagagtgcagacagccaaactccagagaggcaggcgaaggggtgcgctccccagggaatcggtattccagatgagagtccttgggctcttctgaatgtatatgtgggtgtgcacagatgtgtagacatggggaacatacatactgatttttttaagtattttttttgttttttagagtgttgtagtatgggacttcccagatggcgaagtggtaaagaatttgcctgcaaggcaagcatcacaggagacacgggttcgatccctgggtggggaagatcccctggactaggaaattggcaaccccactcccagcattcttgcttggagaattctgtggacagaggagcctggtggtctacagtccatggggtcccgaagagttggacatgactgagcacacacgcagtatacaatgtgtgaaaactgattttaaacatagaagaaataagaataattttaaggacagaaactttgtggtttttttgtatactctattgggtcactttcttttcagagaccctaaggtagatcagtatttgccagacttcagggtgctgagaaaccatctggatggcttcttagaatgtagatttccaggctcctaacagggtgactcattaggatgtgtgaatctgcccccaagcactgcagt

SEQ ID NO: 64750 - DNA, 2550 bp, Bovine  19866880582970
tgaagaccttacaggttgccgcaaggaatctttgtcctcccaggaacctgcccatctctcagtggagcacgatgtggagagcttcagagcaagggatttaaagttgggtttctggatgctaagcctgtctgtctcgctggctcactgtcagatcttgatcaagttattttctgtgttggggcttcagtgttctcagtaaaatgaagacaatcgcagtgctctcctcagagcctattcacagtattttccagagttaatccgcctaaaccatttaggacagtgcctaatacatggttggggttcaataatattgattcacagctgcctcccggtcttctgtgagtttctgagggcaggcgtggtgttgtcatccctgggaaagattttaatgtgtgtaggtaggtgctcagggcctctgtgataagtgaacagtgaaccaggctatccttttctttcattatgcccaactgaaggcaaatatttaattttaaaagactatgaattggggtagcatatatcatgtgtgctagagaaatgaacactttttcattcattcagcagatattgtgaataccagtaatgagctggggagtccattatgtacaggaagtaccatggtgtataagccaggagtttccacccttgtggtagttatattttagtgagaggagaaaacaaataacctcaagatagtagatggtgatgcaccatttgaagattatagctatacgatagtgtttggtcgaactaggaatgggatgagatgcagctttgggctggtgatgcaactttgggttggtggaactcccaactttccctaaaagttaggatttcagaagaaacctcgaggagaaaaagtcagtcatttggagaagtgtgggtagagtctcccagagagagaggagcaagaacagagacagagttttctggaaatgagcatagagtttaaagacatcaggaagtcctgtatgcctggatcttgatgatccaaggggagaaaaggtagacgggctaaatgaggtggtacttctgattcctgtttccctctaagtgcagtggataccactagacatggacgggaagtaacctcccttccctgtgttccatttttgggttgttttattgctgacggccacccagcacagccatgactcaggaaatcctgatcttctgaggtatgcgtgtgtgggagtaggtagtggtggtggtagtttagggctggtggagagggtcctcctctgacaacgctggaaatacattgagttccccaagcaaatccagatggtccaggttctttctgtaccaagaatcaaatgatgatgatcatccagtgacagtggcggccactggtttcattttgactgcgtgccgggcaccattaagtgcctcacagacatcgtgtttgattctcacacatgcccaagagctcgctgctgtcggcatcagggttttacagataaacatgctgagatctgcgaggtgaagtgcctagcccggaggttaaccctctcgggatttgagtccgaagctctggaccttttatttccagcacatttcaaagcagctcatctgcgtctcctcccatgaagtctccccagacggtgcagatagatggggactgaaactcaatgatcagttacaagatgttctctagaacttgcggaaatcatagggtgggcgagctggttttgcaacaatggtcctaatgagccatttagcagcgagcatgcacatgtgtgggagagtcggcagcacagcccgcccttggcacacatttgtgtcattgtttggtgtctgtacacaacttgagatttccaaagtgctccccgaggaagagatgaatggcctttctcagattttatagatttgggggtgaggcaagctaacgtcggcctcaagtctcacggcaagaggatggaattttccaagcctcaaatggagaagccatgttccatgtccttctgtctaaagggtgtattttgaccttcagctgaggtcagcatacccaagagaggttggctgtgtcatagcctctcagtgacttctttagtttgtctagcaagcattcggtgcctctgaggtcttgggcactctgctcagtgtggggagtgcagggtgaataagacttggccctgcctttgaaaagttgtcaaattttcccacccagacgtctgtcctcattcaacctcagcgttcccagcccagtctagtggtgatagggatgtaggcactgacggaagaccacctgcgttcaaatccagactctgtgactagggctaatgctttaacttttctgcccctcggtgttctcacctgcaaagctgtactatcagtagtacgtaagtaaaataacttacgtaagtaacatgatacgtatagcttttggtttcaagttccttaatgataagtatcacctggaatgattgttaaaaatacagtttctcaggcccctcttgtggaaattctgagggagcagctctgggattcaagaccgtggttttctttgtttgtttggttttttgattttaaacaaatattccaggtgatagt

SEQ ID NO: 64751 - DNA, 836 bp, Bovine  19866880643882
cagacacttcttccctgtgtaccttccctgtatataccctgagcttggtattgctattattcccattttacagatgagaaactgagactgaaagggattaggtgacttgtccaatgtcacacaggtagtaactgtcagaatcaggacttgaattggatctgagcaccttagatgtctgagttctatggtaaatatgatctactgcctctattttgaaactgtggcccatacttccacccagttattcattctagaatcctcaaatctgtctaattctccatgaagggaacaggcatggctgcctttctatctctgaaaactgatccacaaaataaccattctgaacctgagtctgtcatttcttggggttcgtgattagccagtgtcctgatctatccagcccccttcctccccacctccatcccggggagaaagaggggccattgtgctccaggtgccccggagccccactctgggggcagtgaggggccccagggtgcagggacccgcgtggcagtctggaccacgtggcggggccgaggcttgctcacacaagccgggcagagtgatttgcaatcagttgcaagtgattacacattgtttcccgtggatagacagagggagccctgaagggataatgagatgcagctgatggaaaatcacagctgactgtcaacagcgctgaggctttgcacagccctccagtgctgtagacaagtcctctcccctgcaagggccaggagcacattgaagaatgttaatacttagacccttcacggtgccattgactgcagggtcacctgttaagtgctagataatcggggaagggtaggacg

SEQ ID NO: 64752 - DNA, 913 bp, Bovine  19866880659127
gcttattctcacaagtaaaagaattggagctcggcaatccaaggctggtatggcagcattatgaaatcaccaagggacaccggctccttctgccttgcagctctgctctttttagcctgctgccccatggtccaaagtagctatagaagcttcagccatgatacatgtattcgaggccacaaaagagtagaaggccagaccccttcttcttaagggtcatttttggaagtaggcacccacacatctggttataattcattgtcatatgtctataccttgcttcaggggaggctgggaaagtagtctatttgtagaatgacatttgctgagaaatagacagtggatattagcaatgatctagcatgcatgcgtgctaagtcacttcagttgtgtccaactctttgtgaccccatggactgtagcccgccaggctcctctgtccatggggttctccaggcaagaatactggagtgggttgccatgcccttctccaggggaccttcctgacccagggatcgaacctgtgtctcctgtagctcccgcattgcaggcagattctttaccgctgagccacaggggaagccctaaggatctagcactaacctagtttacttgccccggaccacgtaacttaaaacaggtgggaggggctgagacctaaatcttactattatttgttctcttattttctgcctttcctatactcagcttttctattatcttcacagttgagaaaatgactagtttttttctcaaacaccctttcagagctatttattttcccatttttagcaccaggaccattctctgagttctgcaaagtgttatggggaacagaagaaagggagagtacgatttcaaccttgcaatgcaatcactccctgcttccataaatcagcaggtttttaggagg

SEQ ID NO: 64753 - DNA, 1317 bp, Bovine  19866880745376
aatgtgaccttatttggagaaatggtatttgcaggtgtgactaaggtaaggatggagatgagatcatactggattaaggcgggcgataaatccaatgagggggtcctttgacagacaagaagacaatgtgaagacggaggcagggaccacagtgatgcatctacaggacaaggaaccccaaggagtccttgcaaccagcagaaactggagagaggcaaggggcagtttcactctcagaatctccaggaggaatcaaccctgccaacaccttgatttggaactctggcctccggaactatgacggaatcaattcctattatttgaagccacccaagatgtggtactttgttaggatagccctgggcactgtgggctcagtcgctcagtcatgtctgactctttgcgaccccatgaactgtagcccaccaggctcctctgtccatggggattctccaggcaagaatactagagtgggttgtcatttcttcctccaggggattttcccaacccagggatggaacccaggtctcccacatcgcaggcagattctttaccatctgagccaccagggaagcctaagactgtcctaggaaacaaatacaccatcttaacccaaagccaacatcaccccttacagcaagggcatccccactactttcagcaacaagacagtaagtacctcccaaggaatcactatagttgacagtgtggcctgctggaggaggctcctctcttgcacacagctacctctgaatccatttaactggcatgtacagtgcctgagctgatgctttgcaaaccaggacagaggaggaaaatcaccagtgaggtgtctgacaactgtccctgcattcattcctatgaccattccttctgcaggttaaagacatctgcttgaatcctgctttgcccacttcttgggtcattccgcacaaggcacttagctttcctgagctgtccttctctaatctataagatagagatcatatacatatatattttgctacagcaaagatgaagctaaaataagaatggatcaaaaagacacttagctcaaaacctggcacatagtaggtactcaataattgtcggtttctttcctttctgaaatattgacatatcaggggtgagcctttgagatgagaattatatttggtcaattatgttattcatagtctcccaattatggtaaaactatagatttaaaaatctcctcatggatcaatttctctaagtcaattgaattacagacaggtaaatcacatacctggaatgttaggtccatgaatcaaggcaaatggaagggtcaaacaggag

SEQ ID NO: 64754 - DNA, 1279 bp, Bovine  19866880845799
acatgattttgagcaaactctgggaagtagtggaggacagaggagtctggcgtgctgcagtccttggggtcgcaaaaagtcggacatgacttagctgaagagcaacaacaacagctgatggacacctttatgtcccttgagttttggagctgtggcaaatagtgttgctgggaacatccgcaggtactcttcttggtgcatatgtgtacacattttagccgggtatatacccaagagtgtctggttttagtagataatgctgaatgggttttctaagcatggttgtcctaatgtattcttcaaccagtcatacaagaaacttctggctgttctgcagcctcaagaaaacaactatgatattttttatccagttaatgtttatattttcaactagactaaatttcatgaggatgagaaccacatgtgccttgccttgttttttttttttcaccatagcatctccagtggctagaacaatgcttgccatatggtaggagacacacacacacatcacctacctcgacaaatgcacaaacaaatatgtatgttctagacactttgtcatattatgatatttgtcttagatttttctgtttaggcaaaatcagtacaatattctatattctcaattactgaaactgttgttatggatgaaaatggagaattagtgagacaatatattaattcccacattgtgccaaactactcaggggatttgacaagtcaatccaaaaagaagccaacgtcctaaggaggaacattttttcaagttccagtaaattttaagtagcaaacaactgtctgtgttcacctcctttagagaggttcctgcactgtcttaatagattgtgtgtctgtacttatgaattagtggtgggaaaagataacaaggaaaaatgtaaaggtgtcttgcagctgtgtgcttcactggggcctcgtcccaagtccacattcacagtcatcaatggaagagctggctctcgttccactgattaatttctacttggtcattgttaatagtcaggttagagaaatgtgtttacacagggcgaaacgaagtgaaaggcacagtacacatgcataagtcatcatttaaacagcatcagaggtgagagggcagcggtattatcggagaccctggcttcctccctgaaccctgcctgcctgcctgcggagagaccttcggttgtattctgttggttgtaataaatgaatgacgatgacgcaagcagagactggaattagaggcagctcagtatatgtcaggttacacattccc

SEQ ID NO: 64755 - DNA, 1223 bp, Bovine  19866880862572
agtcgtgtctgactctttgggaccccatgggctgtagcccgccgggctcctctgtccatgggattctccaggcaagaacactggagtgggttgccattccttctctagggccctgacccaaggacccaaggaccaaacccatggcagattcttcaccaccgagccactagggatgtagctggcggcgctgtcacacagaagacacttacaccaatactgtggattagttattgttattatccccgttttacagatgaggaaacttaaagagtgccatgaaagaggaactttggcatgggctgtatgtagtgacttccaaagagttgaggatgggcagaggggtggcggagagccaggtgatccaaggccatattgacagcgatgtcctgttgacagctggtattcttgatgtcacatgatgaaaatggcactttccctggggtagtcttcccccactcccataatcccgggataatcatgaaggaataaaaaggcagagaaatcccaactgagggccgttctgtgaagcaccatgggcagactctgttggctggttccagggtactctctcagcagccagactggatcaggcctaatgctccttaaggtgacgtagtaggcacagttgaggagaggatcaagagctggtaccgaaacagatacccattgtctgtcccagggttcaccaagaggcgacacaggaagtcaaaagccaaggattccggtaacaggtcaggaaatggagtgactgctggttcaggaccaagctctcaaacaaaaaataataatatttccccttaggttcttcttggttgctggatctcactgtgggaaagttcgtttggggaaaaggcagaggactagggtgacgccagcccatgaaacaggcgtctctgatcacccggtgtcgggagaagggcaggatttccaccgctattcactttcccgtccaggctgccttgcgatatcttttctgtgagcctttgaggagcaacctgtttgttcattgaaaacaccagccacccttaagggctccttagaaggaggattgaacgtcactgaatgcttgtccattaccctattctaatgaaatgtgttctttgaaagaattatttaagtttatgaaaactggtcaatgtgagaagatgtgattggagtgggggccagcagagttgagctgggtgataaaaatagggagttttgtctcccttgggactgatttt

SEQ ID NO: 64756 - DNA, 789 bp, Bovine  19866880937264
tctccataaactgtttattttttctgagtcctacaataatacatgtcagacggctttgatagtttccagattaatgtgtttttccccttcaggtcatcacaagactactcatttcattaaattaactctgctagttgcaaggtggaaacgggctgcaaaacataactgttcgcaccaaatcgggagccggcaagatggaattaataaataaaactgatatcccctcatttccgggggaggtggggaacgccgtgttgcatcgcatcttgatttcccaagctcccactgggagcaatgagccccacggttatgtgtgtgccagaggtgagaagctctcacccaaagccactttggtctgctatctgatggagcccacccccttcccatgatgcctctggagtggagctggcctcaccggcccacaccctaattaaaaaaaaggcagctgtggaagcaaaggcttcaccatgaaagtttcatcctccctctctgcggtgaaagccactgccaaccaggcaggctgtttcacacctgtttgggtccccaggagcttcaggcaagacgtcacctgactccacaccctgcctgaagcctaattttcaaattggaaaaccctcttgactaccccatgcctcccaatcatcggaggccctgtctatccaggaaatccatgtggcagcgtggggaaaaagttattacaagcctccagctccccactgtacagaccggaattggctaacgttttctgggaaagcccagatggcaaacttttgtgggtcacgggggcct

SEQ ID NO: 64757 - DNA, 1951 bp, Bovine  19866881122605
ctgtgtatctgtaagcacactggccacatgtaagcactgtggtccacagtacgaagcgtaacgtgcttcagaatcaaatgaaatgctcaaaagttcaacgctgcaagcatttcctaataatagggctttgaaaaaaaagaataacaaatattagccaaccataactataaatgttatcaagcaaagtaaacattccatctgtaattgttattggagatggattaatatgaaacagtcaacatggcagactcctaaagtaaaactcaaggttgttggagggaaaaaaaaaatgctgaactgggtacaagtgtaactctgatacgatggtggctattttgccaagaaaaggaaataccaattcaggaatttttaccaagaattattgcccattccccatggttttttttaaagaccacttcctaaattataatagaatgtggagagagagaagccacttgacttttcttgggtctcctgccatcttttaagctccctctcaacgccttctatgaagatttccttgctgcccagagctcacactgtgccattctttccatcaaacgcagttgaacttctatcaggatatatggcttgggacaacctagtccgagtcaccattgttattcagctgggtgacagaggtctgcagtggtcatcctgtgtcctttcctgcccctccccaatctagtctccctacttcatgcagctggtgtaatccttttaaaatataactgggttcatattacttccttactttaagcccttcatttgttctaatacatgggaaacagtccagacatcttccaaagcctcccagatcctgtgtgacgtggcccccgtcctcccctcgttctcttcactccagaaacgcagaacgcctttcggtctcatgaatgtaccaggctctttcctgccttcgcgtctcatacctgctatgccaaagccattgaaatctcttctcccagctcactgaacatttttaacaatttctccaagtgatttttttttttttaatgggtactcatgtttcagaacaaagagggcagcaagcttgttctggacaggaccaaatcgtagatatttctgtttctatgggccagtcagtctctgtcaggactgctcaattctgcccatcgtacctttaaagccatagacaagacatcagtgagcaggcatggctatggaccagtaaagctttatttacaaaaacagattcaacaacaacaaaaagaaaaaaaaaggaaaagaagccagattttgcttgctgatcataatctgccaacccactggtgtaaagaagttcttaagtagggttatgcttcagaatcccttcaggacgatttttcacaaaacagacatctgagttcctaaagggatgcatatctgcattttttaaaaagcatcatagatttctgatggaaactgcaggatggaaagaagtgagaagaaaatgtaaactatatacatatatatatatattaatatgaagaagaacttaaaatattttcttccattccccagtaaattgagccttaccttggttcaattactgagcccaattactaggaactactgagcttcctattcctagaatattcaaacaaaaaatgagtaaggctctaacagaaatgatgtctaagaacttctgttgaagctcaacgaacaaaatgctgcccatctccagaacgttgtatagctcgatggcgtgatagagcttgaagcctattgtgaagtaatctgagttcaatcccaagtttaccatgtagtacgtgtttaatcctaacatttttctcaagtatctcaagacttggtttgcttattaaactggggagaggaactaatacttgattggcacggtgccagggtggacacacgctacatgcatgatgtcgtcagcacaaaccctggccctaaagtaagttaccaaggacttatatgcattttttcgtat

SEQ ID NO: 64758 - DNA, 862 bp, Bovine  19866881172381
tttgcaattcaagccaggaaccttgttctccaccctggttttcatcctataatactatactaccttcttctgtggtttccgggggaaaacttgaaaatatatttgagcttaaaaatataccatatgtaagactatgtagaacccaaaggcattaataagaatgcatacttatgctaaacgacattgcaaatgtaaatgtcatgtgtccatattttttctaaggataattcataaccaaacagtgggtacatgcttcagtggtgacgacagcagaacaattctttacaaccaattgccgcctttttagtaattaacatgctccatatagactgaaaggtcatttcttatcctctttctctagcagtctttaatatttaccaaatagtgttgcattgttggaaatgtcacaggctctacagcgcaggggtgattccacacagtgattcatgatgacttagttcattaagaaaattacaactcatttatttggtcactatatctcttctgctctcaaagaattctctgtgattaaaaaagtgaattatgttgacttgtttctgtattgtaggtggctttaattaaaataaaaagataatgtgtcttagtcttaagtatttccttttcaatgaccattagaagtttcagtagaggaattgtgatggcaaatgcaaagcaattcagggatgaattcactttccttttttccaaccactagaatctcattacatgacatctccctttaacctgtttgttgatttgggagaatggcattgaaacatgtataatatcacataagaaacagatcgccagtccaggttggatgcatgatacaggatgctcggggctgctgcactgggatgac

SEQ ID NO: 64759 - DNA, 781 bp, Bovine  19866881204939
gatgctatgtttggggtacatcagacacagtttaggaattacaatctggtttctcaacagagaagagagaatcttcagtttacaattaccatattccagcaaaagatcactttcaatgttttctctttagtcccagcaagaagatttccttgccattcaaaaatgaagtcacatgtactgtctgtgttgagtctgagtcgtataactaacacttcaaaggggaattctaatggtttcactggggtgaagaccacatcccatcagtactgggtttatctgtctatgacgtgtggcgacaacaatgtaccccagaaaaagccgtgacttaacatgttgtcttgctcagaccgcatgtctggtgctggtcggtggagtttctgctccatgctgtcacctggggactctggggaactctatccttgtgtgataccacctctcaagcacttgcttctgtagcagaggaagagggctggaaagtggcgtgacggcccaggagcagcacaccccatttccattcacaccccaccggccagcactcacatcacagagttccagccaacctgcaacaaaggccagaaggataggggagcacatggattattcactgaacactaaacatctttggggagaatatcacgtaaatgtccaatctataccagacagtttatactgcttgatcttatcattaaaacaactctgcaatgtaaaaattccccattcactactggagaaacaggctcggaaatcttaaatgacatgcattaagttcactcaaccagaa

SEQ ID NO: 64760 - DNA, 1218 bp, Bovine  19866881277924
cggattccctgaaactctcatctgaaggctcacacagcccccaaaggaagccctttcacttcatgtgccccttggctcttagcaggaagcgctgatgctggtttattctccccactagactgcggctccagctgaggctccaggaggctgagggcctcctgagccacactaggtggctgccctggccaccgagggtgtgtcatatcaagggtggcacagatgggctgacgggcatgcaggaacagtacagggacctggaagcaggggccggggtggtgagtgaggcaggaggggccgggaacggagctctcagttctctagaaagaggcaggggatgaaatgatcgtttgccttccctgatctcaggagcagctgcagttctcagatcccagcagccctgccttaccagtagccgctaaccatgctgtgaggcagccgagaacgctcctaaccttgcactcgtggggcgcaagtttgcaaggccagggctccaacacctggactgccgggtgatcccgcaggctacagaggaggcggcggcatcagggaggtggcgagacctccactcctatcagcggccgatggggggccaggcctgcggcccgaacacggggcgggcggcagggtcacggacagcagccgcttcggcggtcttgctgtgtatcagcaccaacgcgctctgcagctcatcggtctgtacgtgcagtttcttttttccacagctgtcaaatcacatcgattttcagtcatctgaacctgggtaggatcagcaaaccagtttccccaggtgaaaagctagtttatcaaaggagtcatttatccaatgctctgcgataagaaaggagttttgagtggcttttgggaaacgcacaacccattcccgaagggggttggtaacaatggtcataattaccatttatgaagcatctactacaacccttcacttcacatcccttttattcctctccaaccatcttttgagggagataatagctcaattgatgggtacctgcttctcctgcctcctctcattaaaccctaactacccgctgctgtgtgtattattatcccaattatttagcaaatgaaactgaagcacaaacaatcgcatgtcgcttgcgcctcgtctcataggcaatgacagagctgggcttctgactcagggcttggatgtcaccaacccacgctttcccacttgagcctctcagactggaggtt

SEQ ID NO: 64761 - DNA, 1973 bp, Bovine  19866881287901
atttcaagtttattctgcagtatagaaatccagacaaggaacagcaaactatggtccatgggctgaattcatccagctacttgcttctagaaataaaagttttactggaaatatagccatactcatttatgtattttctatgactgcttttgcattacaagagcagaggtgagtagttataacagactgtacagcctgcaaaacctaaaaagatttactatctggacctttacagaaaaaatttccagttcctgtatagtaagtgagcaaaaatatttctagtgtttacttaacagtctctttatgaaaatgatcatagtttgtattttgctgtcaataagaccaaacagattttaagaacaagctgatggggaaaaagccaagagcataaaggttattcttgctccccaaagattaatttctatgctaaacactaaagcttataggattgtgtttataataaattctttcttaagataaatgatgtaggttgaagccagaaaatgatgatgtcattatttcagattagcaagatgttcatgcccaatgatatcctccaagtaataatgtacctagacaggaataaaaatacttcaagtattatttcagataaaactacagaagttgaatataaaaagttggcctctgatcaatctcagagattaaagggctccaaagtacacagaaattttttcaggaagatgctgaaacacaaatctgttaagtgtgaataaaaatataacctatgattttcataatttaatgcttaaaccctagttgtaaggttacatacaaggtatggaatatgtgttgataataaaaagagaaaaattggtataaatagagcttagttaattccattagttttcaacaataacatctaaaactatctatggggttattgtcacgtcaattatcatttttataatcttgcaaaggaaaagctgaaacacaaggtaaactgaggagagaaaaaaaattatttacccttggttttgctagatctttaacgacttcaatttctgcatcagaaataatatcatggaagcggataatacgaggcttgtcccactcatcctcctgtttggctggagccaggataaatttaggattccggtttccatcatggtagcgacagaagagttttttctgtctccgaggagtctgaacaaaaagtttaaaaaattataaatatattagagtaataatattttaatgctgttcctatgaagataagaagcagtaatcatgctggtgtatagacacagtacttgaggaagaacatacaaaacaaatagtgctctgcaaatattctgcatcaaacaggaccttcagaattcaaacaggaccttcagaattttaaaagttttattaatgattcttttctggaagagatggtgaggtttctctttaacccttctctcatcaaaataaagttcaggccttgtaaatatgaaaaaaataataaaatgattatagaaatatgaaatgaatgaccagccctgcgccaaacttcacaaagtaactgggaaaaacccagaaaagtttcttaaagaaaaaaacctaaccaggttttcccaagtacctcctaattttaaaaagtttaagtgatttttttttacgatgaaaagagagctctgaaagagaaaattagttattaaacaaagaagccaggtgcttttagtagcaggtattaaagtcagcaaaaatcaataaatgtacttttcaatcacctatgtatcacattaactaaatatggggttggccaaaaagataaaaacaaccccgcatggatgttttggccaatccaatgttatgccattgctgattcttctcttgattaaacaagcatttcatattataaagtagaactaatagtgatttatgtttattcttggtatttaccaagaatcaaatccaaggttttaaatatatcttttatatgatgataagaccaatttaactattctgag

SEQ ID NO: 64762 - DNA, 1320 bp, Bovine  19866881399141
ggaagaaaactggtacttgagctcctgggttttcaagtaatcctggtttcccttcctcatgtgactattctgcctagaagcggttgcaggattagggtaccagcaagttacaggccacctgtcaggcagctgtcaagtggtaatgattttcaatcactgccaagcaggttctgggcttgagccagtgacctaggaaagaagtctccatagcccattaccaaactatccctcggggcctttgcttcccgactaacaccctttccgatagaactccatttctgtcattgaatctgtcaacatgcccacaaatccctgaagggtgaaatgaatttgaaccacagtgttgggcaaacgagctcaaaagtgagttcttcagaaagaggagccaatattccagacatcaatccattggaaacaatggctttggttgctccccctgcagcttgtgtgggggtaggagtcggggaggagataaaccaaaaagttgttatatagtttactgcatggcaaaccttaacttccagattctaatctttcatgttttcaagtagatgaagcctgcatgctggtggctgaaactcttatcgagatgaaaaactgaatccctctggagcatccttcttccctctgaccaggttacctgcgagttccagggtgattgcattaggaaaacacagtttcgtagcatttcaaaccctatctatctatgtatttaatatttttttaaaaaagttttccttctgttaaccgtgagcccacagtgagtagcagaagcttcctgtggtaggaaacagcttatctcaaactttcttatcccaccaacatctacacagctcagacttggttggaagcccactatgttttttttttttaaactttgatagtgtttgttgtgaaccagcccagaaaataagtatattttatgtgaagctacactgagcctatcctgttaacttgaaggaagggagtgaggtagggagtgaaggaaacccattccccttgccaggagtcaaagatagggtgtcagagcccctttgacctgccccatgtccagtgtgaactttctgaggccttatatgcacataaaatggacgttgtagttatctaggactacaagatatccacattttcttatacaacacatgccagccttgtctagaggtgagagggaacaggtaagggtttggcttcagtaaagcgaccacattccaagtcagcattgacagttcagtgtccaaccatgtgactccagactttggctccaatttgaaagcacttaatttttccctgctcaacaaatctaatacatgaggcttgcct

SEQ ID NO: 64763 - DNA, 1460 bp, Bovine  19866880503489
attacttttacaaatgacacctaccaactgcccatgtttggcacaaaaggttaactgaacattaagtgaaattattcactagcaaacaaaaatttcaggaagaaggagctgaaatgagctgaacatgatctttgaaaatatgactactacatcatggtacaaattgttggggaaacagaattaaaaataaaatcttctcccaatccaaaaatctctccagaaagacagtagaaaaagaaacattttttaaattattattattccataagcattaaatcgctctcagaggctacaagaacagagaggaatcttaactttttacataccctagccgatacaagtcatcctttacatgttcaaaaaaaatagtaattagtcctcaagtaagaggacttgccagcaccgtttgtcacatgtagttcattctaacttaacctggtaattatgtgggcagctacataacaacatacatacatacatacatagcattggcttgttggctttcccaagaagaaaagctaaattcttattttttttatgataggaggtagtttggcaactcagaaccaagcacccacctaaataagtctaccactgtcccccagaaactgggagagaggggtgctaccttccttgatgttcatattcaaagaggccactcccagtctcttgagagaaacattctcaggttacaaagctgaccaaatgccaatccagtcttcaaaagaattcgaagcacttcccaattatagcttttctaaagtaaatgtcaaagaaggaaagagaaggaaatctctcattttctacagggagaatcaagcctctcatttctcattttcacttgtccttacatgatgcacatgttttgattttattctaggtgtgcaagacaataaaataagtgaaagttcattcagcaaatatatctaagagtgcctactatgcaccaggcacgtgctagtaggtccgaaaccctatgtctttattctaaaataaagaagctctgtgctcaacatcactatttattagggaaatgcaaatcaaaactacaataatgtagaggtaggtgtgtgggggggaggctcaagagggaagggatatgtatatcattatgactgatttgtgttgttgtatggcagaaaccagcacaacattgtaaagcaattatctaccaattaaaaaataaatgaaaaaaaagaaaaagaaaactacaatgaggtatcatctcaaatcagtcagaatggccatcatcaaaaaatatacaaaaaaaaaaaaatggtggagaaggtgtggagaaaagggaacccttcaacaatgttggaagaagtgtaaactggtacggccactgtggagaatagtatgcaggttccttaaaaaactaaaaatagagtaatcatatgacccagcaatcccactcctattcaaatatcggagaagagcataattcaaaacgatgcaca

SEQ ID NO: 64764 - DNA, 3232 bp, Bovine  19866881202665
ctattacactgaaaaattatggagctgtgcaaaccactgaggctaggaaataaaggagcaaaattatcaagtataaatatatatatatatatatatatatatatgtgcacattatatctttcgccgagtttctggcacacagaattgatcaaaggcaagcagactaggttgttgaatgtattttgctatttaacaaagtaccagcccgaccttcaaagcctgctgttgtttgatatgtgaagcaacccgaggactgccacggctgcaagaagaaaactctccccaatgcccatttaagaggtggccatggagtacaacatagaaggaaaaactcccaggagcaaacgccccaaactgttgaagagaatggtctccaaaggaacgagcaagtactaaatgtgctgaggaccaggactcgcctgcgggccaggaccgggggtggtcagtgtccttgcccagaagatgtaactgtgctgaagagcaactgccgttgttccccattccacaccttctgcaaggaaatgtttttattatggatgttctctgcccgcttcattctccatcattctacattgggcgtagtagggattaagactgaagcaaactccttttgttctagttttgaggtagctgagcgatgaaaggacacactaagaacagaaaatacctcacaaacccaaacattttaaaccttggaccaaagggagcgactcgatgggactctgactcctttgggcaggagctagtgattgcattcccgaagaagcttgtggaagctggttctagttctccatccatgtctctcctccttccgtcctcccactctctacctttagtgacaggacctctcaccttaaacggggtgtgggtgcagcatggtctcccatcaagacattcccaggccgctgctcagacaggtcgagccgtggaggttctgaccaagaatacataaatagaagtcgtgagttgactttcagttgatgccttcaataaaaaggctatgtcttcctttgtccttttatcttctttttacagctagaatatgcttgtgatagtgagagctgaggagcatgaccatatcagacctggatgacttgtgtgacaagagacagaaatgaatctatcgttttaaaccacttttatctgggctcttgatttggctgcttagctagtatcctaaggaaaaagaatagatttgcatgcactcctgagtttgcacttatactaacacatgattcaccttcttacctttaactaagggaatatcagttgcaaatagaatttagttctctaggtttcccagacccaatactagcaggcgtctgcttccttccagcttttttgaacctaggaacataaagaaggtgtgcatcaattactttaggctaccagggatagatttccaacttatcataataaactactaccaaaataagtttcataatgatgaactaatgtttctaagagctttctttacattttctttttcaatcccaatatcttataaggtatatgctattattattcctgttttacagatgaggaaactgaagcagaaaggtaagtcacagctgggattagaatccaagaaacctatttctgttttgcaaaggaattcatttgtgtgggggatggtgaattaggggattgggacggacataaacacactactctgtttaaaatgacaaccagcaaggccctcctgtacagcacacggaactctgctcaatactctgtgatgacctgtatgggaaaagaatctgaaagagtgagcacaggtgtgtgtataactgaattgctctgctgttcacctgaagccaacacaacgtgtttattggtgagatggaaggggtgggtatgtttctgtttgtggttgtgttagggtcattttgcttggcttctgctccaaagaggtgatgaacagcgtcagaagacctcaataaaagaatagttttcagtttcgttcttccattcctcagaaagtaagtcacccctctaagatgatttttgtcttagcgttcagatctccagcctcctggaagggttgactcccgttaagtggcattacagaccatttccaatgcagagggccagcttaacctactcaggaaaaagtaaaaacatgtgttaaattgaatcagccagtgggccttaaagtgatgatctgatttagagtcaaagagattttcggcaaaggagacaaagaatcatgaaagaagttaagcaaaataaatggaatttgctttagcctgggagaagaaacatgattattattccaaaaaggttgtaaagaggagctgaaaaaaatcccaagtaaagttgggaataagagtacacattaaaatcaaatgtctttcaatgtagaaatgcactgaaatgtcaaatgtacattaattatctaggatccactttgatgatgtcctcttgttaattcatttgtcagatagcaaaagttagcagccccagaaggaagccatcaaatgtgtaatagacagggagatttggcaggcaggcagggaaaatttagccaagccaacactaaaccacttacggaaatgtaaaacttaagaatgtccagagtaagtcccggaactcaagacctggcagatataggctccaaggacagaagtatatttttcacttacgtttgcatgaatatgactctttggaaactgacctaatttaaagcaggtttgtatgctggacagttttctcttcctcgcataaaacatttcatttagtaataggaaatgctctctctggttctggcttgcaggatgcatcacaaataatcctacaaatgcttttttccttttcattaaacacattattttagctacgaagacccttatctaaacaaaatgcacctgccaacaatgacttaatttcccaagttgctggagaaagttgatagagacttgcaaacttcaggggatgaaatttagacaattcgaggtcagatttggttacatgacaccttacttcctattccctggtccttagacaaacagagatacatccgggtataatgctgacctgtagaatggccacggcacaacctcccgcttcataggagaccaggacggctgtgttctggaaggctctgatttgactgtttgtagttcagagaagtgactcttaggaagatgtcctgaatataccttgtcccacagatgccagttgtttagattgggacttgaggagatgtgttatttctgcagctaagtaagca

SEQ ID NO: 64765 - DNA, 1486 bp, Bovine  19866880515670
aattattaactggagctgtaagctaactcttttttcagagaggtagtgggggacagccccccccgtaaagtcagaggtgtaggtgaaagcacaaagcagaaagtaggcagactctggttttgggggtatatgctcgagaatttccagggggactcctgaagctcgatcccgactttgcgtatgccgagcctccttcctcatgacctttgtcatgggcggagttcctcacgctggctaccggcagtgatagaattccagttgagctattccagatcctgaaagatgatgctgtggaaagtgctgcactcaatatgcaatatgcactcaatatgcaatatgccggctcccggcaagttttcatttctcttgggtatatacctaggagtggaattgctggattgtatgataactctgtagttaaccccccatagtttttaatgtattttaattaaaattcaccttgggcctcaggatggccaaaaaatctttaccataaaatctgtgcttgtgaattctggttttaactgtatagaactatttccctaaatatcactaaatttgtgtaatatacttccttatgtatttgtttaggttgagttctaagtattccgctttttgttatgcagatattctttttacgggaggtgagggatgtatttggctttaatttcccttctctgaaacctcctttagtatgctttgtctaactttcttagaaaagcgctaaatgaaactatgcttcaaagaaacttagaacttaaaactgagaatcaggagacttgagattgagccgtttattagctcagtatcgttgtgcagttcagttgagaatccttgtgaattatcagtttcctaacacagaaaaggaacataaccattcctacctcacagggttattgtagaaagtaagtgctgtggatgtgaaggtgttttgtaagcaccaaagtgttctgtgaatgcaaagcatctcggtgtccagtctctttcatcatatacttcattaatttttaaagttaaaactttcatatgaagcaatttcatgaggatggaaacctgcttcagaatctattaacagctcaaaattccaggctcactttaataataattcatattctcttttgtttatttagcattaccaactcaaaagataaaaacaagtatagttccaaatcaaatagaaagtgcacttcaaatcgttctttacacacacacacacacacatatataataagagatttacacggctgtttttgcttttcactcacacacaaaaaccccgagtgtgttataacagtggccatggtttgttttccatgctgacagatgaataatttatttatttgtgttaaagtgggagtatctatggttataatgataggagccaagaagatttaaatgctgaatatatttgctgaatatacaactagcagttttcagtttatataacaaattaggaaactggcagaacaaaggaaaatccaaacat

SEQ ID NO: 64766 - DNA, 1895 bp, Bovine  19866881311898
ggaagcacacccaatttttaccttctttttattttagtattcccttctcccttcccccaatattgtgttttcagagtacagaaaatgctgcagttgcttttcattgtaattcattttaataatgaaaatgcccaatttctaaaattgcaatttaagccttttgggaacacaaacaatcttccccctgtgcttgggaaagttgaaaaatatgattaacccacagcctgtgcgtgcgtgcacagtcagttcagtgacttcagtgtctgactctttgcaaccccatggactgtagcccgccaggctcctctgtccatggaattttccaggcaagaatactggagtgggttgctgtgccctcctccaggggatctttccaaaccagggatcaaacccgcgtctcttacatctcctgcattggcaggtgggttctagcaccacctgcaaagcgccacctacatcctaacctctgagtagtgaccctttaaagcatcattccgttggatcctgtttccctccgtctctgtggctgtggtttttcctctccagatgctctctgtctcttttgagttgtgggatcctacctgcccccatcagtctctaaagaggtggcccaatgttgaatcaggaagatagcctgtcttacacaatcacaaagcaaatttacaagattcaaatcccttaagtgttcttcgaggtggtccacttttaaaggccaatttttcagatagtttgggaggccaaattcctcctcctttgaagctagacagaatgattttactgcaaggtcgcccaaccaatactgtttatacagagtgactctttgacttattattctactccccacgggtgtgaggattaggatttatcactagacgcatatggcagatattagactgtttggaacccgtgtatctagaagtcacattgagtccagggttgtttggtccttggtaacctggaaacctaattgcaacaacaagccatccaaacagagttattcttctgagtgctcataatgaaagcaataccaggagggatcagtcaggaatggactccacatccctggcaaacaaaactgacttctagcttatggttatcgctaattggggtacagtaattctgaggcatgtttagtggaacttaaaaaaaaaaaaaattccacagttcctggtaatgtgttcactgaagacttcctggatgaagtatcattctttttcatttacgggttaaaatagcctgggtgttttcctccatatccaagcaagtgtaagagttctgctttcttaaataaacgtagtttattttcttcagtatttcatactatctaagcactacagcaaaatggaaaggagcacagtatggtgacttgaatgccccctgcccattttattcattcatgtcttcattttggcactatagatacaaacacaggtggaatagaagctaatacagggaagacagtgttccgtgtggaaaggattttgtgtcatctcttggatttcttgagttgtgttgaacgtaattaaggcacaaagtaagtgaggcctcttataaaacctagattaatcatggaagtagattggtttcaatttgggggtgatagaaggcatccctcaccaattttccattccttttggaacattaggtggctaatattgttgcttatttgtctccactgttttttttagttccaagctatcaccattctccttcaccttttctttgtagtttggggattgcagggtatatatgagctgaaatgaagtaaaaatgcagtggtagtgttttcaagctcgtctttcagcaaacttgagttgatcagagatgtccctgaacttctttttcttgttaatataacagttgatgctcaggaaaacagacaaacaaactcgata

SEQ ID NO: 64767 - DNA, 1730 bp, Bovine  19866881571234
gggactttcatcggtaaggtcacagttttcagtggggatatggcatcttcacatagaaaagaaaaaaggaaaaaaaaaaaaaacaaaaaaacaaaagcatgctaacttacttttaaatagaaacagatagtaggggtttatacctctgctattaagatgcacagcttgaataaaacataaaatgcctcaaatactgtttgtgactaaacagaatatgacatctatggctgttttcagggcacattagtcaatctgcccacgtgggtgaatttacccgggtagcaaatgtgtaagagcaatgaacaagaagagatggaaatctaatgaatactacattgggcaaagagtcttatttccatgtgaatctgaataacctaagtttttcttttcctaaaatagtcaggttttaataaattttttttaatttcatttttttagcactgaaaacattttgtatttaggtatagccaattaacaatgttgtgataatttcagctgaacagcgaagggactcagtcatacatatacatgtatccattctcccctcaacccctctcccatccagactggcacataacattgttgattatccattttaaatatagcagtgtgtacataacctttccaaagtccctaactatcctaaaagagttacttctcaatcttgggtaggacaatatcatccccacaatgtcattaacctgaacctatgtactcacggcagccatcgtcctaaggaatccttgttcaatacccaggctatgccagttgacatcagccaccatgtgagacgtaattccaaacaagaaagctaccaatttctctgtgtcctgccaaataagcaaattagagttggggttagggggaaggtagtaattttataacaaccttattaaaaggattaacaaatatgaattcatttccattactgagacttaacaaaacatcagagacaggtatgttgtagttaccagcgaaccacaaaggacttttttttgaaatgtttctgagtgccttgaaactgctttcagatttatttactagggaagcaaaatgaccacgtgacatgccccaaattttaaaaacattgtttattgaaaataaaactgaagatgtaaattttgaaaaatcatttgttcaactgttgactagctatttactatgtcccatatgctgtgtttggtattaaggcagaagggtgagtagccctcagagcctggattaagggttggggttagaaatggagttactccgggtgcaacaatagtacttggcaagtctggaacggagtatttttagggttacaggctgtgcctacctcatcccagggaagaggatagttcttccggatataatgaacacttgcgttaagaaatggagtccagtgagtgctctctgacacgtcatggaattgtcctgacaaaacagaggcaaccgtcagagctccttcttaaaaggttggaggttctcttgtatatacacaccacatctttgttcatccattcatctgtcagtgggcacttaggttatttccatgtctttgctaatgttaatagtgcttcaacaaacactggggtacttgtgtctatttaaacaatagaatattactcagtcataaaaaggaatgaaaatgggtcattagtagagatgtggacgaacctaaagactatcacacaaagtaagtcagagaaaaatgttgtatattaatacataaacatgcaatctagaaa

SEQ ID NO: 64768 - DNA, 1253 bp, Bovine  19866881925465
tcctagactatgagagcttatgattaactgcatagtatgtgtttgatgaattgagctgaactgaattaaaaggaaacccaggttagaacagttgttgctgtaatcaagcaattcagagttgaggaaactgaggcccataaagcaacccagccaggacttcgaaactaactcctgagatctttctactttacataataagcattttattttcatttctactgacactttctctgtgaaccctacacttacttaaaactaatctcttctagtatcttcagcatctttagtaactgacagcatgtgatttatgtgaatttcagatatatcattagttttcattgcagtgacccatttttaatcaatctcttaacactataaatttataatgaagatatggggtgttactagcaaacaaaatgaatattctgttaacaacaaggaaacacagcctagtgaatgtgctaatatgtcttcccacttgcatttatttgtctctgcttaatatatatttagcttgatttatactttaatgccccacatttgttattctccaacagatggctaagatggcaaatgcaaagaaatgaggtccagatgaatatccttcccttttcaaggaagaaaatatagactaccttctgagtgtagtataaattccctgacagtgaacaagaatagtttgcatgtcagaagatgtctaacaaatagtatttgttcaagaagcaaagaggaatactttcttcaagagcatacatcccctctacatctacagaaacttgagaagcttgcctgctcagtcacagagtaattctaagtcccctgcctattggcactgagttgttgacaactgtggattttgcagtggattcccctgtggagattcacctttacagttattagatctcaaggtaataaagagtttggattcctgtaaagcacactacaagggacattaaactagctgtgctttggatatctgaatatgcgatgcttgtgaattcaactcattgagtccataacttgagtatctgaatgatctttgggcagagtggtaatttgtatagctagaataacccaagaattgaggatcactgctttgcggacttattatagtcaaaagcacatttttgtcaagttcgaggcccatggcttaccatacccaagaggtcattgctcaaactattggccaatgcagctatgaaattttatgcatctatgtacttgccctggtggctcagatggtaaagtgtctg

SEQ ID NO: 64769 - DNA, 1243 bp, Bovine  19866882044441
atgctatttgtcacagcttaaatctccttccctcccctcccctccaagtgaactccgtgagggcaggaatgtttcttttgtggaactgctgtatcccagaacctcccacagtgcggagcataacaggtgctcagaaaatgtctgatggatgaatcagtgttagattcccttggtacttggacctcattgctggactgtcttcttcagacgaagaatgctgaagggcagggtagaaaatgacctctgggctgactacctgtcataaactaaatgaaggagaaaggaaatctccctgcctcaacatccccccacagtctctccccctctgacacccccccacccccaattctctacttctgcctatgtcagttaatggatatatctccctattcaggccccaaacctggagggtggttctgggcttgtctcttcccttgcccaaagcccccgattttttcccccagttctcttcactccccagttcatgacttggcccgagcactcactaccagcctccgtgtaaaccaccctgttagcctcctgcgtggtcttcctgcagccaggcaggtacttcagatgctctgaaatcatacgtgctctcacctttcccgaaaccaaccaccctcccccagcggtctgttcgcttgtaattgcaggttcgtgttctgctcccctgacagtgaaagtgaagtagctcagtcgtgtccgactctttgcaacccccgcggactgctgcctaccaagctcctccgtccatgggattctcccggcaaggatactggagtgggttgccatttccttctccaggggatcttcccgacccagggatcgaacctggggctcccgcattgcaggcagacgctttaacgtctgagccaccagggaagcctttcctcctctacccgaccttttatgaggctcgagagccgggccatgctccctaacgcccgcaccaaacttctttgttgtctttccacaaggtgtatcctagagcactggggaggggagaggtgacacagctggtttcactagggtacaaagcccctatcgcccctggatcctgcgcgcactcaccttggccgagacccccctccagctgcagaaagcctcgtaggcagcgcgcacggcggcgcgggcctcgggcaccccgcagtcggccaccaagcccagctcggcgccgctggccgggtcgtgcaccgggaaggtggcggctgccgagacccagaggccgcccacgaagccg

SEQ ID NO: 64770 - DNA, 1755 bp, Bovine  19866880245571
tttccccatctatttcccatgaagtgctgggaccggatgcatgatcttagttttctgaatgttgagctttaagccaactttttcactctcctctttcactttcatcaagaggctctttagttcctcttcactttctgccataagggtggtgtcatctgcatatctgaggctattgatatttctcccagcaatcttgattccagcttgtgcttcttccagcccagcgtttctcatgatgtactgtgcacataagttaaataagcagggtgacaatatatagccttgatgtactccttttcctatttggaaccagtctgttgttccacgtccagttctaactcttgcttcttgacctgcatacaggtttgtaggcttatttatttccttccaaagaggaaggcacaataatgataagacagcaataattaccacacgcagaaaattgcagttttataacaagtagaagcacagagataagtataaaaggcaaaatgcaatatatcaaagataactgattagaattaatattaattaatgttaaaaacatcactctaagctcatcattctgttagagtttgaggaaacccagtggttgttatctctgtttacttcacttaagttcaaaatctgttaagaaaacagtggttttggcagataaaaatcaaagtggaatctttattatcaataaaaatggcactgaagaatgcaaattaaatgtactcagcaaagtcttaacactgaacttaagtgttacacatgcccatccactcagttggagggagctctgtgctaccacatgtttgttttcctccagggcaatcgaacaaacttcgtagtcacattcagaagctcttcaatgtacctattataattttgttttgttttcctacgcctttctaaattacattacagtcaatatcccttctttctttctttttgacaaaacacttcaaaatttccttatggtatgctgtgtgcatgtgcttgcgcaacatatttgggtatgtgtatgtgtgtgtgtgtagcaaattccgtcttatcagcaacaaaatatttttttaaattgtggttagatttgataggcaatggaaaatattgagggttttttttgacaagtatcaaatattataaaattatatgctaaaattttgaaattgatcatgttttagaacgtcccgttttcctacagctaatgtagttcataaaatgaagacattaagagaaagcatttataaaagttaaagcaagtgactcatacacagccaactctcaagtagatgacagttccctttctccttttcatttccttactctggacccttggaggaaaaggatgcaattctgaattactagtcaaatttaacaatcaagtagagttggtagcttctgaaattattgtcattgatttctttgggcatcatttaaaaatagaattgtgaggtgttataagaagaaatagacctgttataatttgggaacaggacaaggaaaacagttttccaaaatttccttgtgcccttcagaattctccagtcagtatatttgttcttgatgttatcactacactttcattttcacttttcaattttatggtggatttgaaagaaagtctgtagcttaaggtttataaatatttaagctcttgctagatagagttgagatctgaagccaagtggaaagaagaaaacgtactcgggggcaaaacaaacaaaacaaaccaaacacgaaacattaggaagcctcaaacagtgcctg

SEQ ID NO: 64771 - DNA, 1268 bp, Bovine  19866880506154
cttgactgcttttgtaactttctgatcatttaatttgtagagatggtttaatctgaatgttgccaaggcaaacgagataggctcttctctcaccaccgccactggttttgcaaaaaaaggaactattcaaacttacagtataaaatgatttttttgttgttgttgttaaagagaattatgataaaggaaatgtgtgactatttaacaaaagatggattttgaagtatttattatttccttcaaaaaatgtatttcattccccagttcaggacacttcctgtatactagatataaacctgtgaacatataaatgcaatatggggtgaaaaaatacagaatgaaaagatctcttctagataaagggatcaagataatcatttttattttttaagtatatttaactggctctggaatcctaagtaggattagagtaggaaaaaaattaggggttgagacacaaagatattccaagaggtggaaacagtagtttcagagaaataggatgggttggggtaaaacttcacttcagtttggccttaaccttcagttcttgaggaggaagcatgggacagtggacctggagagatagattaatatcatattagtattatcagttaaatgtaagtaataacttgtcttgttttggaaaggattgcaggttctttatgaaggtacagaagccttttttttggcagacttgaaacagggctatttctcacattcctatcggtaattgcctaatggtgtgtagagatgaaattgaaaacctggaggcttgccttctcagggaagagtgtgccttgacacttcttactgaactgttggtttcagaagaaacaaattatttaagctaatatttctttctccattatttttgtaatacagtctctgaatctacagatttaataattgtttgcctgtttctggctgaaatttcatctctatgcagcagtttcttatctgctgaggaaagaaatactgtttttctataaacgaaaatgagggtgatttatggatgtgatgacttaataaaatgtgctggactcccatttctgcccatgaagaaatatctggcatggaatatgccctcccactttaaactactagaaacctgtaccaaacgaactattttcagactttggaacaataggcttcccaggattgtgaccatggagagaagggaaacaagtgacttaaggcctaagatcacctgggcttcctgtcagtacttggcacagggaatggggggatccaagcagcatatggtg

SEQ ID NO: 64772 - DNA, 2214 bp, Bovine  19866880509320
acttcagagacatagggtaacagaatgcccagtgatcacatcccccaaatttaatctttgttatttccagtctgatttctaaagacagtactacctgaccaagagtatagattaaatgatcaatgttactttatatgcaagacttaagtttgcaatactagctaaaattagggtaataaaattcccccatgaaaagaaggactggccatgttggtccatttagaggtggctggaggagaagggggccgacagaagataagatggctggatggcatcactgactcaatggacatgagtctgagtgaactccaggagttggtgatggacagggaggcccggcgtgctgcgattcatggggtcacaaagagtctgacatgactgagtgactgaactgaactgaactgaactggactctatgctatactacactttccttttctccaccagtctaatacagtcttgccagtctcatgagggtgtgatttcctagcttacccaatataggcccaggtctctcatctctgaagtctgagactcctagagtcaactgtcattaactgagaattatagatcaatgaaccagtgtcacctttcaaatcaaacatgattttgttcattgtggtgtctggtaaaaatgttggagggaaagagagaaggaagaagaaacaaaaaagtagtagaatgggagagaaggaggggaatatacttatatgaattggtagaatcaattattgtaaaacagactttttgtaaatattgtgctataatatatctgacaaagaatttaatttgctctttaagggggtgtgctatcctataagttggagaaggaaatggcaacccacaacagtgttcttgagaacactcaagagaatcctggggatggcggagcctggtgggctgccatctctggggtcgcatagagtcagacacgactgaaaatgacttagcagcagcagcagcagcaggagctatcctataaagagtttaagattaatattatgatatctcctgttcctacctatgagaccttgaacaactcaatgtctcctaacaccaatattctcatgaatatgataaatgttaagcatattcatttcaaacattgttgaagggatcaaaggaactcatctatataagatcaagtgcacatcatagacacttttctttccatttctccatcatactgagcatcaagaacttcctatttaacatacataaattgtccacttataagtttatatgcaagacaatttgaatctcaagtctctgaagcccaattataggaggatgagaggagagtatattggcttgaaatgtaatttaagcttttaaactacattataaatggtaaaacagcagcaaaaatacacccactctgaccacagatatctaatcatccttaaagttaacaaggtttacctgggaagtttatctggttcaataaaggcaatgttgctctgactaaatgtaagaaattacattcattagtaagtaacctgtgaaaagaaaaacaatttaagtttccatttctgattgctgcaactatgctaatctttcaggcctccaactccatctgctttagaatgtagttctgtttgctgcctgtttatttcccagtgaatgaaggggaaggggatgacaggggatgagatggttggtggcatcaccgactcgatggacatgagtttgagcaagctccgtgagttggcgatggacagggaagcctggtatgctgcagtccgtggggtcacagagtcggacatgactgagtgactgaactgactgactgaaggagaaggacgttctttccaatatatgatttctcaggtagtgctaagatcaaacatactaattcctactgcagacttccatagcttcttgttagagttccctgccaattcggggtagtcatcatttcttacctagtggtgagtggtattaaggaatattctctctatattcaccacataggaatgcttttttaaaaaataaaagtgcaaggaaattccctgatggtccaatgggaggacttggcaatctcactgctagaacctgggttcaatctctggttggggaactaaaattccacaatccttaaataagcaaataaataaaagcacaaaatttatatttagaaaggaggaggattctttagctaaatctcactgggaataactctacagtctgttagttcttgggaaatttaaagaa

SEQ ID NO: 64773 - DNA, 1389 bp, Bovine  19866880552958
aaacatgtacttttcactaatatgcatttgttacaaagtaaatgaaaattgcatatgaaagggatttgaaagccataaaatactaccaaaagaaagctgtggatatttggaatgctcttctcaataaaagtgaatacctgggaagacatatgaaaaggttattgaataagaaagaaaagaaaaggaattgaaaaaaaaaaatttaaaagcaatcacaactatatcagtggaagccatatgaaaacaagattttttcaaaattggcttatttctagcaaggtggtaagttcctatatggtagtgtttatttgttaaaacaagcaaaatgtgggaaagttttagtcttcaaacactgagccatttacttgtgatatatatatatatacatatatatatacatatatatatatacatatatatatacatatatataatacatatcaatatatatgtatttttggcaaataaggccaagaaagaaattgaagaatttctttggactttatattgctagttaaactcgttaaattagttatatgtcataagggcatgccagtgagattttttggagcttgcatgagcatttgctaccatccacaaatttcctaaattaaatttttctataatatagtactgaacaccaacaacacagcatagaacttagagatctttattatgctttggttgtgagttgggttggattctgctattgatttttaagtaaaaatcttaactttacccataaagacatcttgtttcattttcattaaaaggtaggctgaactttttttcaagtccatcttctggaggctctataattttctttgaagttttctaaacttctttccattttgaagtccatggacctggaacatatgtctagaatgtgtgcatgctggtagtattttaaagattatttccttaaaccatgtccaccaaaaaattcttgataattttgctgcaggaagcaatagtcagtaatcttctttgagcattatctatcagatacaatttctctaattacactgcatcagcttttctaaaagttctgaaaacgtttccataaactaaaggtgttacacaaaaagatgtttttctgatcaaataaatttaggaaatgctaagttgaacaaggttaaacaggtttctttcctgcaggagtcccatgaatactttaataagataacatctgtcataaatctctaggagagaatactgattgatgatgtgttttccaaagttgcttcgtcaagtagcttacaacattatttagaccttttatgaaactctagtttggaaatgttaattctatgatttgcttgagtggggccttgaaccactgaatgggcctaatagcaagaaatttcattttttttcagggcttatcta

SEQ ID NO: 64774 - DNA, 1560 bp, Bovine  19866880636952
agcacgcatgcagaaacattcatgcaaacaaaatatttagtggatacttacttactgcatttgaagtattttgaagtttctgagcattgccattatcatagtatgtaaaatacagaaaatatcttccatggcagatataatggatttgaagatttggaacatcactgcaataaaaaaatgaatagacatttggtgatcttctgttgaaatttaaattcatgtaaaccaggcctttgttacctgttggttagttcagggcgtaataattattagatttgttaaaaagaaatacaaacttcatctcataaacgaattggcagactttcttgcattttaattgctagaattatatcttcttcacttagaagttgtattttcttttattgaccaggctctgtgtgctgctgtggtgaaaccagatgttctggaaacaatggctttgctgttcagtggagcagatgtcatgtgtgcaacaggtgatcctgagcacagcaccccctatctgctggccaagaaggcagggcagagtctgcagatggaatttctctaccataacaagttctcaggttagtccctctcatgccttcatgaacctggtctctcctgatagatccttaaaaggactgcagcgcaaatctgtaaatttctcaaaacagaaacaccattcaaatgaaaagaaaatgtaattgtcagaaagacagaagatgcttattaagacccatgttttatttgctttcaaggaaaagtttaggaaatcaatcttttatttgtctttaatcatctaaatggaagattaaaatagttaatcccatgtaatcattttcactaaaattaaatccagttttcatgtatgaataataaacacaaccaaagtgcttatttgcaaattttatgcaaagcaaaataaatgtttctgtgtctttattctgcagtatatttgaagtagtttttcttctatctcagaactcatcaacatattcataagccaagggaaaattgtttacatttcagatttcagatgtggtatttctgtaatttttctagatttccctcaacatgacatatattctgaaggtcgattaaatcaagagtcctcccagtctacgttcctctgtgactttttgtatcaggctcctgctggtgcttctaaactctcttcagaaaaaaaactgcttgaaggtatcttttctgctccttttagattttgtcatctgataaaattttatttcattatcaaaacaattaggtttaagttttgatatttttccccttgagatgttagatttgatcttgcagtagagaaatatttattttttgaggatttataaatgtttccaggcacaggtattatttcatgcactgcagcaaaaatttactactggttcggaatgctgagcgaattctcagcagaattctctgacatctacctcggagacaaccaattctgcttcacgatttaagagttattccaaagaaatgtgaaattcagccccttcccttcgggacagaccccccagctggggagataatatagataaatgtcaacatgtaggaagaacg

SEQ ID NO: 64775 - DNA, 1693 bp, Bovine  19866880697890
atcccaggggatgggggagtctggtgggctcccgtctatggggtcgcacagagttggacacgactgaagcgacttagcagcagcagcagtggctcagtaatcaagaatctgcctaccaatgtaggagccccttgtttgatccctgggtcgggaagatcccctggagaaggaaatggcaacccactccagaattcttgcctgagaaatcccatggatggaggactctggcaggctacagtccatggggtcacaaagactcagacagaacttagtagctaaacaacaaaaacctgtaaacagtagctcgcctttagtgagcgtgtactgtgtgtaaggcattgctttaggctttttctatatgttcattgtaattctcataaaagctctgcaggatagttgatattatgctggtttcacatgaacagtggaggaactcagcatgaagcagagttttgcatttgatttgtgttataattgttactgtatgactttggctttggtcagtgtaatgaccaggtgacactagatggcagagcatctttattctttgagtttaggttttcttgtttttttttttcagcaaatttatttccatgtcttacttttctcaatgcaaccaataataaatgatgaattttagagattttctcatcttcccattgctccttatcagtatttaatatttaaatagttgaaagttgtgtgatcaagagggaagaagtaccagaacaatctgtgaaatgatgatagcaattattaaaataattgaataacagggcaattaatgtaattgttaagaagtgtacaagttttctagaatttttcttctaaattgcaggatatattaatctacccttctaaccacttatacaaagatgaaataggaaggaaatctgaaatatgaacttttcttcctaaagcttctcaatatatcataagtattctgcagactaaaaataagcttctagttattttttgacaattctggttataatatttataaacatcaattcattttactgttttcttgaaatatattgcttttcttaatcaccttgagaactgaattgatatttcaaatttgtaactaaatcaatttttccttttataaaagataaattaactatggattttgttgttgttgaaatttatttcaaaaaacagaaaccagtgcattctccatatttataatttcattagggatgttttctcattttgaagcattctgttttaagtgatatgtactttgactatggagcacacagaaatgatttcattggaaaacaatctaatagtctaacagcaaggtattctttgatagtcttcatttattccatccagtatatcagcaaggtctgtcattttaactcagaatagaccatgaatcagttggctgctctccatcttcactaacatcatctgaaccccagtcaccatcttgtcctgcctgggctgtaataccctctaccccagcccatatgtttactggttaatatcttccctggcttccctccaaaccattctcccaaacagacatagtgattgttgaaaatgcagatcagatcatgcatgtccattgttcaagtacatttagtggcttcccattacaggatataacccttttccttatctgacctaaaagaccttctggtgctttcccctcttcatcttacatccttccttcctatcctac

SEQ ID NO: 64776 - DNA, 1490 bp, Bovine  19866880810165
gaggcaggtcaagtagtctggtattcccatctctttaagaattttccacagtttattgtgatccacacagtcaaaggctttgggtggtatatgaagctgacaatccttcccagatacataaccagtcatcagtttatcttactttactaattatgtgattccatggagaaggcgaaggcaccccactccagtactctttgcctggaaaatcccatggacagaggatcctggtaggctgcagtccatgggatcgccaagagttagacacgactgagtgacttcccttacatttttcattttcatgcattggagaaggaaatggcaacccactccagtgttcttgcctggagaatcccagggacaggggagcctgatgggctgccatctatggggtcacacagaatcagacacgactgaagtgacttagcagcagcagcagcagcatactacattatgtaacacagtcgctaccaaggcaaaatttcatatatttttgaaagatatttttttaattagagaagtgtgtttgacataaacaatatttaaatcaattgattcttgaaattctggtgttggagaaattttaacagagagcaacacttcattccttcttcccctctccttctttccctttctcttcccttccatctttgcatccgtttttcccccctctttccttcctttctattttctttaatgattttatattatggttaataataagcagattctagttctcagctgctaagatacacatctattaaagggacatacatgaggctcattgcctttcagtactttcaagttttgaatatcaatatgattaataaatccttagtttatagaaaaagcaattacatagtatccatgttatctcaatgtcacaatttatttaaaaaatcatattacaaataaggtattcataattcacaaatagatgctcctaactatacaatgagttatgaagaaataaaaaagaaaattgtgctactctatgccctgagattcatcatttatgcaggcatttaattctccagtaaaagttgtcaatgttataggctgaaatatcaatttcacattattccctcctaaagaaaattttcaattatgcaagatcttttcagtctataaaatacgttcccttgagtcttagttctctctggctctttccattcttttgtcccagcagatgacaggtaattattaaaatagataacttccataaagatcacaatatgctctttaattcacaatgcagttacaaattttcccctccatcttgaggtagtaaaacaggttcaaaccatctacttaggcatttatttactagttacttagtaaacataatcatatattgataatatgtgtgggtatatatacatatacatatatataaacctcacaccatacaaaacacctaagttcttaataaacagttgcaattttcactcaatatatgcatataaattaaaaatttattctttacccgg

SEQ ID NO: 64777 - DNA, 1852 bp, Bovine  19866880963432
ttccactaggtggcactgttgatttatctacttctgtagtttaccctcattttgtcttgaaagcggagtctgttttttcttttgtatttatttatttttacaatctaatgaaaattcctgcataggaaagagctgatttgggcaattctgaacttgaaaaatgggtgtttcttgccattagaaaccttataaataagctgctaccaaataagttagttcttttggcgtacaagcaagaaggttgatgacatatgtaactcccatctggattctgtaggtgtagaagcaaactgtctttatttcatctatatctcactatttggggattcttttaaataggaacaatgtcactggaatatcttcctccttacctgctttatttggtaatccgagacagtggcatgcccaagagagccaggttttcaatggctttgcagcctatgctgagagaagcaatttaccataggcctgaatgtccctgcacattctctttgggtattccaagaacgcaaaacgttggctctctgggccatttctcaaaagttgcgtttgcagggaacagccttgagggatgcagtcatgtctctctctagaaaacaataagcttgtttttatctactgtaaaagtgatgattcccccaagcttcgtgttcctccctgtaatcaagcaacatccatcatggctccttggtgctgcccccatggaacttggggcaagtcaggagttgatgcaaataaacatgaagctctagtctgggacctggactgtttactgctgtgcttgcacctgggcatacatctccccgagcaacaaaatacaaggagactgcatgggactaaaaataactgcacgcatgcacaattggggcacattctggacaaaagatacaaagagaccaaaaaaaacttccactgcgattttgaggagcctggagcaaaagcagcgagcataccccctgcatataacatcacctacggggcacaccagaccacctgacctgcctcctgagaaatctgtatgcaggtcaggaaacaacagttagaactggacatgaaacaacagactggtcccaaataggaaaaggagtacatcaaggctgtatattgtcatcctgaatatttaacttatatatatgcagagtacatcatgagaaatgctggcctggatgatgtacaagctggaatcaagattgccaggagaaatatcaataacttcagatacgcagatgagatcacacttacggtaggaagtgaagaaaaactaaagagcctcttgatgaaagtgaaaggggagagtgaaaaaggtggattaaagctcaacattcagaaaactaagttcatggcatccggtcctatcacttcatggcaaatagatggggaaacaggggaaacagtggctgactttgtttttggggctccaaaatcactgcaagacagtgactgtagccagggaattaaaagacgcttactccttagaaggaaagttataaccaacctagacagcatattaaaaagcagagacattactctgccaacaaatgtccatctcgtcaaggctatggtttttccagtagtcacgtatgggtgtgagagttgaactgtaaaagaaagctgagcactgaagaactgatgcttttgaactcgggtgttggagaagactcttgagagtcccttggacagcaaagagatccaaccagtccatcctaaaggagatcagtcctgagtgttcactggaaggactgatgttgaagctgaaactccaatactttggccacctgaggcgaagagctgactcatttgaaaagagcttcatgttgggaaagatgaaagcaggaagagaagatagacagaa

SEQ ID NO: 64778 - DNA, 1509 bp, Bovine  19866881075725
accctctctggctagctcttggaccctctctggctagctcttgagacccaggagaattatgaggatccaatcaactgaggacattatgtaaaaacactttaaaggccataaggtgctgtagacctataagaaattctttgtagttttttttttttccctcttgaaaagttttaataggcctcattagaattgggccagaagaacttgagtgatgttgagacattgaagggaaaaccacgtttctccaaatttgaaaattgccatagaagaaaataattaggtatgaataattaccttggcaaatattaccattttaaggagtaaaatttcattttaaaagtaaaattttcattttcatttgcagtataatcgtttagataaaggtaaaatgaagaaaaactgcatttgatacaggaataatagtggggctagagtttgatcaaattagataataaaacagtaattccatttctaggatgcattttattctttaatatgcatgttccatatgaacactgaaatccagatgaatgctaattagtaattaatattcatcaacttgtataacagtcctcaacataatggtgattagctttagatatttatagtatcatgaattagttagagaaatgcatcactttcattaggagtacattatgttccatagaggaatttgtgttttgatattgagaaaatacaatgtttttaaatgcgggattgcaaggaaactgacacatcagtaaagttgaatggataatgaaatattttccaaagagttaatttttagtcttttcatattccttttttttttcaatccatggcaaaaattagtctgtcaacaagtatttctaaccccagttagtcttgtgctaggccatagaaataggcaccaactctcaaggttctgtccctcttggctactcaaggacgtagccctaacagttgtcctttgcttcttctgcatcttatttttctttctattaatattcttatcaacttctaaacatgctgttatcttactgtaaaagcgttatatcccttcagagtatcctgttcctacatgcagcttaatacctatctcctcccttgatgcccttgtcctgttgcactttggtccatcagcaccatttgatcccatctatcattgtctaattcttgcctttcaggacaccattctccactagtttttttgttcgctttacagatagttccttctttgtctttgttgcttaaatctaatattcctgacatccaaagtgtagaattcccagggcttggtctaagacaatttctattttctacttcagttgcatatttttgtgatctcatctgctctcatggccataaattctactaatatgccaacaactcccaaatttatgtctacagcacagatctctcctgtgaattctaggctaataaatttgactgatgactctacatccccattgagaggtaaatacctcaaatataatatttctaaaataaatccctgatattctccatgaa

SEQ ID NO: 64779 - DNA, 2392 bp, Bovine  19866881101043
aatctgcctgcaatgtaagaggccttggtttgattcctgggttgggaagttccctggagaagggataggctacccactccagtactcttgggcttcactggtggttaagacagtaaggaatccacctgcaacacaggagacctgggctcagtccctgggttgggaagatcccctggaggagggaacggcaacccactccagtattcttgcctggagaatccccatgggcagaggaacctggtgggctacagttcatggggtcaaaaagagttggatatgactgagcatacacacacacacatatatatatgtgtatatgtgtgtgtatatacacacacacacagatacacacacacacacacatgtttcatcaaggagagtgtttttaaacatccactatgctaaacaagctcctaatttcagtctggaaaacccatttctagtgcttgttttgctaattgatatttcttttgcagtcaatcttttctggcattgttcaagataagagctgaagttgtaaaggctgactctagagtggactttctgattaaatgataacagaccacccttggagtgtgatttactgattagaaactgtcactcgagtacagcttaacacctacggtaacatcacaccttctatatagaaggtgttttaaaataatttacaaacatggtaatgttgattttctctgaacaggatcagaaagtggcattcttttttaatcccaaccaagtacaatgtctggcatggagaaagtgttgaagagggagagattaaatcaaattttgtgggggctaagtaaatgattaaaatgaggaattagccatgaatgactcatcctatcaattttgccactggtataagtgggatttgctcagtctccttgaaaacaccctgccttagaagtaatctatcatcatcatcaattcgatgatttttttttaatgaaaagggatgcaattatttaaaaacataaacattttaaagtttgttctgaacattcaaaaatatttattatagaatttttaccactttacatttgtgtataagatgtacttaacaatgtgacactaggggtattgaaaataaatttaaggcaatcatatttctaaaaccaaaatagtaattgctatttaatagatgtatttcatcatagaaaattatgatagcttttcctaattctattggggttttgtattttcttcccatgcaatctttatgtatctcatttctagctttcataccagatatttttagatggctgtatttaatattttaaatcattctattgtacttactataggtcaaaagcaaaattgcctcttccaaatttattttattttgcaaagtgttcttttcaattttatacaaatagaaactgaaagataatttacacatcctttttctcagtttgtaatatacattttaaaatctgaaagcaatgactgtgatttagattgtaacattttttcaagagaaaataaaatctttttcaaaaagatatatgaagtgatgtgtgcatgcaaaaaaaaaatgttctggaaaatgtacaatagtctaacttccagtcagattattatgattgcatctttattttatagtaaaaaattagaatatatgaatgtgttctagatttttcaaaagtagaaagtgtgtgtttctgtatgtaaataagatgtaaataagtgcataaaattattattatcaagaattaaagagttttcttcacagtcaatgatgaagtaaattagagctgcctggcaataaaacaaatatcagtttcaaatgaacattttgttttaatcttaattttacatttgttaactactaacaagcaaagacctaatagtgttgtagaaatagggcttccctggtggctcagatggtaaagaatctgcctgcaatgcagtatacccgggtttagatttctgggtcaggaagatcccctggagcagggaatgacaacctactccagtattcttgcctggagaactccatggataaaggagcctggcagcctacagtccatgtgatggcaaagagtcagatatgactgggctgtttccacttccacacttttctgtttgatgaggtacatttttttttccttctacacatgttatcgcatttaattctcatcacagccccagggcctccttcactgcatgaccctgaacctcaggccctgcacctatttttttaatataaatttatttattttaattggaggctaattactttacaatattgtagtggttttttcatacattgacatggatgtacatgtgttcctcatcctgaacccccctctcacctcccacccaagttcatgaacttgatgcacagtgaggccaaacaaaccaaaatgtcagagttggagcagaaaaa

SEQ ID NO: 64780 - DNA, 1583 bp, Bovine  19866881107513
catccagcatcgtgcattgaacctggactggcatctcgtttcatacatgacatttcacatgtttcaatgccattctcccaaatctttcccaccctctccctctcccacagagtccataagactgttctatacatcagtgtctgtttttcttctctttttgtatgtcttaaacactgagtctcaaacacaagtctgaagaccaggactaactactttagatttactgtataaacatttgaaaaatacaaattctaggccaaggcaaaaggagaagagggtggccgaggatgagatggttacacagtatcacttactcaatggatatgagtctgagcgaagtccaggagacagtgaaggacagggaagcctagtgtgctgctaggaggtcgccaagagtcagacacgacttagcaactgaacaacaacaggctgctcactctagattcttgttattcagtagatctgggatgaaatacaagcagtatttttcaaaagttaaccagatgattctgatctgccttcaggcttttaaataacattctttgactaagaatttatcacttcaggaatagaactggaactcaaggacacctcatttataggaagttagcataaaatttaaaaatatatacttcttacagcatgcatttatttatgaataatgataaaattaaacaaagaaagtacaggtattttcagaagtccaattttacctttctggtttcagtttcaattttcaaggtaaacttttcttttgtctattataaacgtcaatgggattaaattattagcagaaaattacaataaagactgaatatttgaatcacattctctcaagccattattcctttctacacgttcaggctgtttttcagttaagtttatgaatccttccattcatgtcttccccatcccttctaatgaggtcattttaaaattaatgttgaatatctcttttagagtttgagtagttttcaatttgtctttctttggaaattccccatttgatttctggatctcacacaaattcttttcttgctcaagaagactgagcacagtggtttcctcacagcttcgtggggtgactgccagcagaagtcttccattttatagccagggaaaatcatggtgacagtgaaattactgtgaatgaaatttatttttctgattataacactcatccactcctaggggtaccctgtccttttgccaccatcagttgtcacacttactttgaaataaatgtgaaaaggttatgtgaaaataagaaattagtctcacataataattcacatttttaaaatacttagagcttagaaaagaatattcagctacctcttctgtcaccttggtgtattcgctttggcaactggatctgatgcattacaacaggatgtggatatctgctctttcagcaagacaatacacatttcattcgaagacttgactagattctttatgctgaacttggggagataagctaactttcctggagttgccaagggcaacttgattgcacatgaaattaggaactactcgaaaaaataatgtctagacacattcttatatttcatttcggggaa

SEQ ID NO: 64781 - DNA, 921 bp, Bovine  19866881138769
atgcacatgcacacacgtgcatgcacacacatgcacatgagcacacacacatgcacacacatgcacatgagcacacatacacacacgcacgtgttcacgcatatgcacacgcacacacatgcacacacacacacacacacactataccccacaatgtaatatactaagtgattagacttgaggttttattaaaaatcaaatagaaagcaagagttaaatcatggcataaagttaatgaactttaaaagcccaataactcaaaatttctagagaactggtagaaaggaaacaaaaaaaattaattgcaaattaaatgtgatgctgaccttaatgtttttattttaaaagaaaaatggtaaccagtttggtagcaataataaaaggaggaaagggtgtaaaatccgttagaagttttctcaaaggaggtggcaagatttctttgaaaaattaaacttccagaaaagtatgggatattttctttatttttagttcaaaatctgttacgaagaaagagttccagggaagagaagtataaatggcagcaccagacctccaaaactccacagacttctaacacctccggggactgcagttgtctcctccgcctacagatttcaatcattcctgcagcccctgccttcagccatctgaggacactccatcaatataactgataacaaacccaatctgtgtactggagggaaagttaatacagaacatattcaaaataccatttatcccagaagacatgctgacatcctagagttaagaaatatggtttcttctcacattacatcccttatgaataattgttgacttctttgttttttgattgcaattcaaatgatgaattaacagaaactgtaagaaggcatctagaggttgtgcaggtgaatggagcactatagcatgtcaatccaa

SEQ ID NO: 64782 - DNA, 1102 bp, Bovine  19866881148690
ccaataatcacaatgcttgaaaaatgatccactggtctgaacttttctgacattattttgagggaactcgattattcacatatgagtaaattcctccagttatagttaggaataaaataaaaatatgatgtaggccaacattgtatgagttaaacagaatacatctgtgaaccatccgcggtcctccaggagccagtttgcaacctctgataggaaaacacactcagtattgcacttagatttgttaagagcagtacaggaagcgaagagaggaaggaatgaaataaatcactaaaacatttcaaaatgaatgtattcctcttcttcttcttccagttattcaacagacaggatgtaaagcatgaagtttaatacctttaaggaagaagataggccctgttcaatagactgtttaataaatcaggaatatttatgtcccacttagacacattttgaaaacatatcctccattctaggaagtaaagctaaataaattatgttgtaggaggattgttctatgtcattaaatattttagaagttttatttagaatatttcaaaattgcataatgttctatataacgtaacaattccaagtggactttaaaaagacatggatatctttctcaggctgattgtactatataaatttatgtatattaatgcaaagtaactaaacatgaacacctgcacacactacagattctctttacaattaattctaagcatttattgccttaatagtcatatggtactaaaaatgtgctacttttgacattatattacattttgttgtgggcatgccttattggcactgctaacttgagtctccatgatagtaaagagaattcagtccaaatctgcctaattccaatacttatccaactatatcatgttgcctcattcttttgtatcacttataaatccatgtctgacacacagtagataataagtatcaaatgactacatatatacataatataaaaatgtgtcttagcatggagcaagtgggaggttcatatcaatggaaaaggatttatagtagactgaagtgcatataggcttgtagcccaatttctaaaatttaaggttatgaatacctg

SEQ ID NO: 64783 - DNA, 1742 bp, Bovine  19866881170495
caaatatatgcaatgtacataaaaatccactaaatatgtataatggtaaaaaaaaaaaagatttgctttgaaattgtatgcctgcacacatcctcagacacaaatatgttctttcccaaatttataaagacatttttgaaataaaggtgccatgggggttattcggaaacaaaaagttattttgagaaaagcattgcttctggatgcagaggcttggggttcatttcccaccatcagcagtaatcattgtgctgcaatttgtgggattttgatgctctcttttcctaacatttttgcagctaatttccctctgttccagaaataaagtatttataagcttcaaagattacaagtaaatctcttcaatttactctggattctgtattgtactcttaatcagagcacttttttaaaatgcatctgtgtctattttaaatactgtaagagtgaggtaatgctttaagaatttatttattatttaacacaattgtagaagtttcactttaaaaatccatacaggaattaatgaagggagaacattgaaacttaagcattttaatctgtagataaaactgaattgaagcttgaatttttcgaatatgtcagggctgcagtcattagaattctatgagcactgaaacataaaaataggatttttcccctcccattttttaaatctacattaaagatgttaatgggctttcctgatagctcagctggtaaagaagctacctgcaatacaggataccccagtttgattcctgcatctggaagatctcctggagaagggataggctacccagtccagtattcttgaacttccctggtagctcagctggtaaagaatccacctgcaatgtgggagactggggtttgatccctgggttagaagatcccctggagaaggtaatagctacccactccagtattctggcctagagaattccatgaacagaggagtctggcaggctacagtccatggagtgacaaagagacggacatgactgaggaaatttcactttcacttttcaaagatgtttaatatattgaaggaaaaaaaatccaccagtgactactgttaaatgtcaatatttctcaatattcttcccatctccattgcttcctctcctacatacatgtattttcaagtttgtcgtcacacacaagcacacaaagctacttgtgttatggtgcatatcatactgagaaaatatcatatctgttgaatttaaagatatagctcaggggaaatttagattttcttcaggaacacatttctctttctgactttcattttctcaatgatatttaacatattgaagagatatttaaacatttaatatattgaaaccgtaatgaagagcattccctatgagaaaagggagaggaaagctgaaaaacagaaaaagaatggctagaaaaaacagcagttctgagatgtggagagatgagaaaagaggtggatgtttctatgtcctatgaccaagaatgacctattctctacactctgtatcccaccctccaataaggcctaggagggacagcaatgcacctgaaagaaacagctggatcgtgggatatatggactaccagctttgccaagccttctgttccccaatgtgaacagaagcaacaaaatggcaatcccgcaatgcgctctgcggaacaagaaagtgagccgtgtgggagtaagaaagcaccatgagaaacctcaagtgctttcgaactgttcaagtcatgag

SEQ ID NO: 64784 - DNA, 1077 bp, Bovine  19866881239641
tttgtaggaatgtttacatgcatttatacatttttttttactgaattatttttatctctgatagctttcgctgagaaagggcagttgtgaatttctgacaagttagtacgtgctgttgaaaaagtgtgaaccaagtaattaaatcctatttgaaaaagaagatagatttagccactgctcacacctcttcaactcctcttatcaagctttagtagttgcttttttgaaataatactgcaatttctgttaacctcaatggacagttttaggcaaaatatataatatggttttctacactattgataggtttatggaatatttatttttcgtttggagagtaaaaatcaacccaaatagaaatttaacatacagatgctttgtctttatagataacatattgaaaatgcaccagaaatgttttgataggcattttcatcacaaggactgcctatgtttgttctttttgataattttatgtgatatttgattaatagagcatttaagtaatgaattcaattgcagtagaggcattctggctctcagtttagatcctgaaacatgaagatttaattacctttagtttatctagatagctacaagcagcataattggtcataaagttacatagtgcttttttttcaaaactcagacataatatttgactcaagagcattttgcatcagtgaattctattagcggatacaatttgttggaaacagtctaattcttttggaaaattgcatctttcttatttgtatatgctacacttttattggaatagataaattttgcaagaaattaaaaaataaatgaatcatatttttgttatagagtaatcttatttgttaataaaaataatgcatgtaatccattaattgaagaacataaatgttaatctcagttattttgcatgagtactaaatcgcttcaatcatgtatgactctttacaaccctatagactgtagctcctgcaggctcctctgtcctccactgggattctccagacaagtatactggagtgggttgtcatgccctttctccagtggattctccacccagagatcgaacctgcatct

SEQ ID NO: 64785 - DNA, 1091 bp, Bovine  19866881332117
ccttacgtatagattctgcatcttgcatttattgtacatcattgctttaaaatcaattggtggcctcactttactaataccaaagatgtataaagaagcaagaacctaatttatggtaactaaaccaatagaagagaaatataaaacaactgtataaatcttataatttctagagaagaagtgaaaaggtcttcattttcaaaaattttcagcataatgctctttacttcgggatgcttatccaataagcattgacactgaatgcattttaaagaactgagaaccgtgaaagcatactctagtcatagaaaagtgtatgttttcaatatctatacatagaagaaccttctgacacacaagaaattgaagcagttgattcttttttaaaaaggagggcaagatgttaaacaaattctttgctaaaagagcaatatagaatggtcacaagaagacctagaatcactcagccgaaggcaaaggacacttgtaatcaagggcactaaacaaactactgtttgtaacaataaactgagtgaatgaagtttattttgttgacaccaagtcagcagcatacgagctgaagttattatgttcaatatcctgtccctaatatggggaacgttgttcaagttttaactggggtgggtgtacatcagatagaaacttcagtgagggaggaaaagtttacttgctgttgataatgaatcctcaagtgaaatgaagggaaaagatctaaggcgcaatgttacaaaaggcaataaaattaaacaataattttatgaaacagcaaaattttgaaaaattttttgaaattttcagaagtttctttttttaaacatgttttcaaaacccttggtacacacttaaaaagaccttaacatccatgtcttttgttacatttcactggttaccttatttaattcttccttggtgagagacgccaaaaggggtttttctgaatcttccttctttgtacttctgagtgataaaattttttctcttttctactgaacagtccatgtgtaattcttcatctttttgaagattacccagcccaaaagtcatttagctcttttgtttccaatgacaat

SEQ ID NO: 64786 - DNA, 2052 bp, Bovine  19866881420484
tctaatgagttggctctttggatcagttggcccaagtattggagcttcagcttcagcatcagtcctcccaataaatattcagggttgatttcctttaggattgcattggtttatggtctgtcccttcctccttgtgcctaagctccatgagggtgaggataaagtcctgtttaaatctgtactgccatataacatggtgcctagcacataatagagtctcattaaacattcattgggtaaatgtgttacccttaaatcagtcctaaattcaatatgcctattcttaaaggcatattgttctttattaaactttttttgtggggaggaggagggggattccaaaataagtagaaagttggtttcaaaagcccagagaagtcactattctttaagacctcttaaattatatattcaatgtatgcatggcagttggtgctaaccattgtaccaaaaatcacaaggaaagtctagcatttttgtaaactaatttcagtccaaatatctttagctttaggacttagatgattgagaaacaaataatttcccactaaaaaacagtgatgggctcagtgaatctgtcattctgtcagataaaggactaagggaccctccttgatttactctagagaattttttaaagtagttcctttggaaaagttttcattctgcttaaagctatacttggtaaatgatgcccaagatactttaaactcatctaaattattgcatgtgtaatagacacatcactaagagaggaaagagcaccagacaccattgtaaagaaatattggaaagtgcacattctacatattaggaaattttattaatgaaggaatgatgagcactgaaagccttcattatccttcttctgtgtgaattcagatattagacttcaactaaacgcagcaagtatttattgactgacttctgcatgaaaggtgttcttgaatttagatactgaggataaatagataatctgaggaacctttcttcaaaggatgaactcaatgtaagcaaatatttgtaacacaagtagcaaagtagtatgtgcaaaatactatggaatggagggaaaaagaaggaacaaaaatctctagtttggaggatatgtgatgaaggactttttaggaaatcggaagtaaactgaatgcttgctggggctttaggaccatagggagtaattcagatcagacggttctaactttggtagttttaatggccttgaaaatctgaggggtgagttgtgctgggaaccacaggggttgtagaacagaacagtgtgtgtgagtgtgtgcacatgtgtattttttttgtgttatggagagacagaaccactttagtgaattttatgcaaaagatatctcagttatattttaaaatagttgaaagtgtataaagtttgaatcaaattgaggtttgattttggctattctgtaattcaggcttatatagcaggaatctaagaagttgttctaatatagtaatagtactcttatgctttaaataatcaacagggttgaaaagtctctatagttcatatatttttaaatagaaaaacaggatcctcagtaagcaacccaaagtatttgtgactcaaatacttatcttccttgattatatttatattttctataaaagggaggtttacagaattaaaaaagaaaagatgcagagtgccagcaattactttgtctttgaggtaagggaggggagacaggaatcatatccatgtcacttcatataattgcagtagtaaatttttgcatattggccttcatttctttgtctcctttaactttggaacatgttagactttactcctctgtaccttataaggcataacatttattagctgggatattatgaatagttgttaccattaattactttgatactaaatcaggataataataatctgtttcagataaattaaaagttgctttgttttatgaagtctgacttgtcaagaggaaaaaaaacttttcctatgcttgaagaaagcaaacctctaaactgagaataatctaatatttaagcaagacaaatacaata

SEQ ID NO: 64787 - DNA, 1610 bp, Bovine  19866881423001
actaaagaaaagcgtttgtattattttagccctatgttttttctgacagaattttacttaaagaggatagtgtttttcattttaatagtaccaagtatttccaaataggacacttcatacaatttagtttcttatactgtttttccccatgctggtataaattaaaaaaactgccacaaggaagcctgtacatggatatattattttttttagatgaaatgattttataattgagttaaagaatctcatcccttaacagaatgatttttatgaatatgtgtctttttgaaagcatcattctgcttaatctaaaataagtcatacaaatcggtagacagtggtaggactgagtgctcgtctgaaagttctttttttttttttacatttgcaatattttccccatgtttattgaactataattgacaaaaattgcatttgttataaaaatatgtttttgatatacatatacattgtaaaatgatgaccacaatttaagctaattaatgaatgaattaatagtcattacctcatatagttttgtgtttatttatggtaagaacatttaagatctactatcttggcaggtttcaagtatacaatacagtaccattaactgttgtcaccatgctatacttagatttcgaggacctattctctctgcacaactgaaatttagtacccacttatcaacactttcccatttccctcagtcccagtccctggaaaccaccattctactccctgcttctttgtgagtctgacttttttagattctgttcaatacatgtaaatgagatcatacagtatctctcagaaagaatgttctttaaagacactgaacacattttgtttctatcacagcgacctcaggttatggaattatagtgttaactgtttgaaagttgtctttatgcatctgtcagaatcagttaatgcgactgacactttcatttgcacagtaaggcaggcagatgagggacatggttttcctttaaactcaaaccactgttattttcatggtgttattttgttggttatttctgcatgttgctggtctttcgcttttaatattgatggccaagtcattggcaatgtttgcttttcaaatgagtttacagtaaataatcaatagtaaaaatcttcaaacttatctgaatacagatttggctctggttttgacagttgcccttaatatatgtatgcttgtatatatttagaaaatgatttactgagaagggagtagaaattacaaattgaaaagtatatttaaagagactgtgtgttaattagagataatttatgaatgctcattaacaacaaattagagtaatacacaggggaagatatattttgttttgagagtttttcctgcacagaaaatattaattaaaatgttttcagacttgatttacataaaaggttagaagtttcaaagaatattaccattatactgttaatggtgtcaaaaaaaaaagcaaatggggaggggattgggttgttaaaatttacatgcactaataagcaaatttttctcattaacaaggataattttttaagcacactaatttaattggttcaattaaaattttactttgaaatacagtgcctga

SEQ ID NO: 64788 - DNA, 1183 bp, Bovine  19866881439682
ctctggaaaataagaattgggatcagttcctcgaaatactggtctccccatgtctttctccctctcaaactctggttgagtctccatctggagcgcggaacccaccatgcttactaattatgcctgggcttctaagatccgactggggaggcctcagtgtctcctctccttcaggagaacggaaggacgcctgcggcctacgtaagtggtgcaagcttcttgtcttgaagttttattggtctcccgcataaaccaagctactcagcctcttttctccactgaattttcctactgagctatgctcattctattactctttatatcgttgatgaatatttaaatagtcaccgaagccgtctccccttcaaataccctggatcagccggggctggaccctggcacttttcattttgaattatcgaatacttagcttttcctcactatttaataaaataccttaaaattttacagagagtaacgttttgtctggcaaatattaactaacattttatcaaactagtattcccattactcccttccatcctttatatctttgaaaatgatctttctaaaatttaaatttaattatattaatcctctgcttgaaatcctttttaagtaagataaagctgaaattcctcatcaaaataaggtcctaatttgtctagccattgccagtcatttcaacctacatcttacttcattttccctggttactctgtcatcaccctgacactgcttaagccctttctccacatgatgcatttgcaatgtgaatatgatcatttccatgttctgctcaacactctgtaaaatcccctcatcatctagcacataaaatgcaagctcattaaaatagctttcaaggtcatccatgatctgtttatagcctcactccacagccccattttctatcatgcctgacttcacacttcatgctcaaacaacataaaactgtatacagtccccagagacacaatatgattcctaacctctgagtctttgctcacaccaagttctggtttttttaaatgttatccctttcttgtttatgtctctctcctaactttttgagtcttaatccaggtgttccttgggcttcccaggtgacattggtggtaaagaaccacccacttgccaatgcaagagatgtaagagagggccagtttgattgctgggtaag

SEQ ID NO: 64789 - DNA, 779 bp, Bovine  19866881829215
atgtataatatgtgtgtatgtatatacatatatgcatgtatacatacatgcatacatgggagaacaccttctttaaagacaatgctcaaatctcttcttttgaacccattgaaaacatttaacaaaaacagaaaacaaattccatatgtttatttgcccactgagaaaatgaaagacatataatcccaataaatatctatctgcatactctacatcaacattaaaattagaagagaaaattgagtgtattgataactgaattttcatgatcaattatatttgcttcactaaaatgaatatcactgaactagttaagagaaaaaataaaacaaaaccgagctaaaatgataaagctgttcataactctttccacgtgagtaaaatattcactgttagacaggtgcctcaggtgccctttctttgggaaataaagaacaaatctgacaaaaggattgtccatactcagcagtgtccaaatgttgatgatcatgtcgtttctatctaaatatttttttttctgtttttcatatcctgctttgaatcattccattggagcccagctaagctcagtcaagcttgcaaggctgaatgtgcctgccaggcaggcttaactatttcttacatgcttagaggatattgaaaaggttactgtattaaaattgttgatgtacatgaattaaaaccatcctttctcagatgtaagccagcatgtggtatttctgaagataagacaccctggtaataattacaaataccgaagctgtcgttcatctaagcta

SEQ ID NO: 64790 - DNA, 1701 bp, Bovine  19866880423243
tttagagatcatctaattagaaattcagcaggactggaaactttgatggattctaaagtgatgtgttaagtggtaagacatctaggaaatcttgatgaccaccgtcctccaccatgtgcctaatgtctctatttgcaaatcccctgagctcagttaggacaagtgagggcccagtttcagaaagaagagtgtgtgcaccatgtatgcattttcagtacatgcactgaaaataattgaaacaaagctgtgactgtagcagctgaggtaagaagttgaacaaggactgtttactatcatttgagtattctaatttctttcccaggattctcatggaaatcagtaagaattcttgatctttttcatgtgtagtacagtcttttatgtctttatatatgtatttgtttatagtccaacccttttttggaaagtggactggagatcattcttttcctcatctgtttaattttgaagaaattatgggacccagtccattccccaccaatacagaggtgggtccattccacgctagctaccagactctatccttggaaatcacttactacatagaaacactcagatgtggaaggaaattggaagagggttgtctgattataatgctctataataaatttgaagatagtgccattaaaatacttgaaactattctgattttgatctggtctaagatttagtttttagtttttgattttgtgaactacacatttttaaaaaatgtattctccccctccttaagcataattggtttctgttgatggcaaccaaagaaatatgacaaaattaaatacaaaaattggattctaggcaatagacctcaagaaaatgtgagttaccttgatttaattttttgagatagagtaatatagtaagattcctggataagaacataactgctcatgttctatcacagcaagaggactaatcaagtctactcaccaggagtcatgcacccactgaggatgaaactctctggcactggaagtgaatccaaaaggctaatttaaaggagataagggatgccagacagtggggtggaatatttgatcctgatggtattggctaagttaaagctagaaaaacaagctcatgttgtgaaatgctctctcaagatataaaatgaaactattagccttcctgtgatagtgctaaaaaaataccttattgattgtagcagttgctcggagatcactgaaaatcaaactgggagattgattttttttttttttgagttgctgagttatagcagcctttggattaataaccttgccaagtcttttaagtgaaagttagagccttgatcaattaagagtgagatttttataactgaaacaataaaatccaagaggattttgaaaggtctgagaactctgaactaatgaatccatctgcagtaattttcactgttcctttcttggctgagtataggcgtcttttgtaaaagaaagtcgaaacatccactagtgccttactgcctctaagtaagtaggattttaaaaatatcaacatcggttaggtgatacagtgaaaaaaatcggagtaaaaatgattgcaggaattaatgaatttaaagtctctggggaaatggatattttgagtgcttaaccatggatggttagacacaactttggattgggctaaattttttcaaggatgaacttactagagtttctgtacttaatgtgg

SEQ ID NO: 64791 - DNA, 1149 bp, Bovine  19866880958240
caagcaggtcgataaggacagaataagtgtcaatgtgaaagccagtctttgaagtggactggtgagaagaccagtcagatgagaggatgtacataagggaagggagtagtgaacaagattttaaagatagaaaagccagattctgagtgccaggatggactagggactccatatttggagggaaaaagaagccactcagcagttgacaaccaggttgataagataaaaaggctattttaggaggtttaccctggcagtggtattcaaaacagattgaaaatcactgcatgttaaaattaacttatgacccaaatctactaaatactttggggatgatatatttaaactaaattttcaagcaggtctgtcacatctccaattccgaatttgttacaaatatccaaatattattttcctattctttatttaaaaatttagattttagaactgttttaagctcttaaaaattcaatactctatggcaggagtgtgatatattttatttacacaattttacctgctgtgacagatagtttttctgcctaaaactatttcatacaaatattatatttatatttaaataaaattaaaatttttatattttattaatatttatttaataaacattatatttattatatttagaatatgatttagtttaatatatgaactattgtttgcatatatcattcatcaaaaatttatccaggaactaattttaaagaatgcctaaatcaaacagcttctctgtaatatttttgactcttgaaaataagcagagaggttaactgtttatcatgtacttttgtggacatatttatatttgaattagtggatatctaacctgaggattttagttcctaaaagttttctttttcctctaagacaatcttgttaataaaattttataattatggggtcaaatgatgaattttccaccaaagaagaattttgctttatttattttcaataaaacttagttgtattgtaacatgaattattttaatcaagtttgttagttaaccaatgcatactgaactaaaaaacaaatcttgtttatgttgtagttttaaaatcatgcttgcttgttgaacactgttggtggtctgaattctgaccttcaaccattatctgctattcaaaacagca

SEQ ID NO: 64792 - DNA, 1301 bp, Bovine  19866880449941
gctcttcccacacaccactcaacaggctgatttttttctctttattattagacataatatataaacacataaaacagaaaacagcagggatcctcatgggcctcaaaaaccagcagggaaggaagaggccctgggaaactttttttttttaaagtacaagatatattagtggccggaccaagggtgtggaaggcaggccagagccagcagagctgaactataggctccttctctccccacagagccaggacagccccagggagctctcccccagcagccagtccacacaggcagattgctgcctatgggaaaactctacgatggagagcctccccctctgggagagaagggcagtgcacagggtaactaaaagctccttccttccatcctttttccctccgtggctgcaagtgaggaaaaggaaagctgtgtcctatgcacactgactcctcccagctgccctgggccctgatacgcccatacttggcatttaccaaagtctgtcccagctcagacccaccaggtgcccagagttttgctgaggagggaaggggaggggaaaggctgggtatgacaccaaatagatctttatttgcagtcgtcactggggccgtttcttgctgcttatttgtttgctggcttgctcttctagctgcatggccaggcgcaaggccttgatgacatctggaaggcaggggtggtgcacttgaagtcagcaggtctcttggagaccctgttccctcaggcagagccaccacccacccacagaggccccaccctccagctgcacccacctcgcagggctgagaagtgcttggcttgctgggccagggcacactctgctttattcacaaaggtctccaggtcgtagtctggctgctcagccatctcggagagctccagccagcctggcccttgctgcagcgacacaagacggaccttgtcaggtcaataatgaccaaaccaatttagcaaatcattcccagggctctaccatctgcaatgcggatgcctgttcctctagccatggccctggccctgcctcctgacccttcccccataactctcagcttgaatctatccttcccctgcctgccaaaaacttgtccctgtccctgatatcaaatgcatatcttgatgcccaagccagaaatctgagcaaaaattctttcaccttgtccctcaatcctaacaactgcacccctgaaatggttcttaaatctcatgtcatcctgtcaatcccaagaccatggtcacagctagtctaggcaccagtgtctctcctgaactctactaatctc

SEQ ID NO: 64793 - DNA, 4009 bp, Bovine  19866880494754
caagaggccagaggaagctgccttgttctgggagctgcgtgcacaacatttgggtgtggagctcttgagcctggaagggaggtgatgccaacaccctgaagtggtttccaaaaggaggagaaggccccctgagggagctggctgagagggagtggcctctcatggtaatgatcccgtggactccgcagccccagcgcctgcacgcttttacaaggttaaagcaacagcttgaacctgtatggggcgagcatttgtttcctttccagattgccagctaatgaggaaagattaaaggagctaaatctgtttagcttggctaagtgacgaccgaggcggcgggagtggagaggcatgctgggcctgccgggccgaggaggggtgtgataactgactgcagatttcagaaaggtgtctgtcgctccagcgcaggaagagtggctgtctcgggtgggcaaggggcctcagcctccctcagtgggaggagacccagggagggtttcccagctgtgagcgtggttgctcatggtgcagtaggtcaacctgccgagaagaggtcagggatcaggacatcctggctcagctaagggagggaccacctgtccgcaaccagcagccttcacttagccctctgctgacaccaccttccgcctttgcgagggtcttctctcgcccactgctgtccccacggcagccagggccttaggggttttggaatccaaaaaggttaccccacttgcaggcctatggcagatgttcttagtaactggtttggggattcatagccaggctattctttgatgatgtcttcaaatagagtcttccaagcctgtgagatcagaaccttctaggagcagaaagaattttcccttagggggaggggggatctagtgtcctggtccagcgacccaggggtccccaagcctggacccttaggagaactaggctgcctctcatcctgcttcctgttggcaatctcacagttaaacacttaaacaatctttctttctcctgctttctctctccccctctctctctttctctcccttcttttcagagttgacaggggccaaataaaggcccttttaaaaaaaacacacaaaacaattttgttccttctgaaagtgatggagcgaaagtgagtgtagattatagccctgtgaggcgagggccttcgtgatggggggagaagtagtgacatgatgggaacctaatggcagtaattggccttggctttgacagggcccatatcacagctcaggaaaagagagatgtttaaagtaaaaatttacacaaaattatatgttttcggggtgaaaagactgtttggatttcatttttttccttcctcttcttccccccagggcatggttcctgggccttctgccggtgtgtgtctatgtgcatgtacacgtctgtctgtgtgtgtatgcgtgtgtgtgtgcacacttggccatgaagctgtcccacaggtatatgtgcattttagccctgcgttgtcagtaccttctgttttctcccttattcaagtggagacattgctcagctttggaagtttctcattccgaagcaggaagagcctaagagaaggaaaaaaaaagagaactattccaaataatttaagaggccacccttcataatttcaccaaagcaacacttgttcagtcttaacacagtcaactaacatcttgtatttatttatccttgtagttcttagtcctaaataagaccaaggaatagactgggccattgtgcctgttcagtgtctgattcccattccagaatgtgagccctctgagtgcaggtctctctttctctggttcaaggccgtagtccagcacccagcacagcacctggcacatagcaggcttccagcacaagtggcccaggatacccgaattctgttgagacagaagctaggttggaagatcataactgcctgaggattaagtgctgataaatcagacttttgtctcaggtactagactattcagataattgagtatttttttttacttaatttttattggagtttggttgctttccaatgttgtgttggtttctactctgcagcacagtgaatcagctgtacatatacatatatctcctcttttctggatttccttcccatttggtcgccacagagcactgagtggagttcgcagtgctattcagtaggttttcatcagttatctattttatacatagtatcaatagtatttatacatcaattccaatctcccgattcatcccacccaccacattcccccttgatcaatatgtttgttctctacatctgcatctctatttctgctttgcaaataagatcatctataccatttttgtaaattccatatatatgattaatatacaatatttgtttttctcttactgatttacttcactctgagtgatagtctctaggtccatcgtcatctcttcaaatgatccaatttcattccttttaatggctaagtaataatattccattgcatatatgtaccacatcttctttattcatctgttgatggcagataattgattcttcattgcttattagaaaagtgacctgacaggaagacatccaaaggtggcaatgcaatgagaatattaggtgttcatcccttgttgtgagcagtcctacagtcaaactccgatcaactctttaatactaatgaccattcccagggtagcatggtctactcagggcctgctacttgtactgcagctcactgttttacttggatttagacaaagtgtatgggctaagatgaggtctagtcacctagcagtctacttttgagctttctaaaaaaaaaattccatttgactaacataataacaagatgcacaaataaagctaaattgaatgtttttgcaacatgagttcaagatgaagtaccagaatcacagaatctcaggttgggaagggtctttagaattctgaagtacatccttcactagttgccttcgcaacctctacaataactctcaagttccagttgtgaagattggtgtgttcagccaggaggcagggttaagaaatgcaagaattaggagctgggctgggcaggaaccagtcctggggaatcggtcagtcgtgaggaacaaacagacttagaaaggggagacccagcaaggactgtgccagcgagttgctgtggaggtgggagtccattctgaaaggagaggtctgaaggttggtgcagaatgggggtgtataggtattgggaacagggccaggcagctttctgtgacccccctggtttacctcagtgtttgaagagaatttcaacccaggcaactcaggatgttccaagatcaccaggggaatccagaacactaggtgggcattgctgggggtgggagaagggcagcagtgtctagaaccaagtgagaatggtgcttctagagctgtggtagtcactgagatgttgtcttgtgatgccagtataattcaatggatggttctggaatgacacagggttcttgaatggtacatgaagtcagcactgagttaggtaatagcaggtaattctgtaaatgatacataggattgctgtgctctagaagtaaagagcatgatgtgattacttatgatcagaatataggttctcaaagaagaattgaggcatttagggtttgggaaccattcttttgtaccaacatttatggaatgcctactctattgaggtaacatatctgatgaaagcccttcaggcctactacttaatttgagtcacttccccttttatttttcctatatatactgaactgagattgtaaacaaagaaaaaattgcctggcattccatccaagaaaatcacaatatgtgagaaggttctcttgcaacctcagagttctccaagttctgtagacaatccaagagtctaggggaatggctgcagctcagttttcctcttctggcattaggtacagagatggtaatcttgtcctcctgtattccctctgtatagaagtattaaaattgtaaattgcaagcattttccta

SEQ ID NO: 64794 - DNA, 3139 bp, Bovine  19866880505468
ggcacagcaacaggcagactctcggccgtagtgggaggggtggtggtgatgcaaggggctgagctgctcaatctgccccaggcccactcacctgccttgtgttcggactcccagaaccacccttcctgatagcccggggccagggaccacaaagcaacttctccctccctgcccctgccttctcccagtggttctggtctcggaccacatcgcacgagccagtgcaggatccctgctggggacacaaaggactgaaagcgacgggatctggggtgagtggcatcgatgcaaagcagctcagagttctgctcaatgatctcggaaatttcttgtccattcttccactttcagggtcttacacattcacgaaggcaacaggcttgtagtgggttgccaagcctctcatctattgcttcgtcctgttgccatagagtcctgacccttcttttccctgctccaacactgcctgcggctcctcactgtgcccgcaaccaattcctactcttaagccagacttgctacactctggatgctcccacttcttcaccttctctcatttcgctccctaagtcccacatacacggacagacttactccacctccaatgtcaccctgtctgtctggctcatgctgtctctccatctggaatgttctccatcattcaagcccgtttcaaaagcactttctcctgatccttctctatcctacgcctctggtttctggtctcacaacgcgcccacccgtcccagaagcaagcagcaccagggaaacagagagctaacaggtgctgcccaggcccacccctgcccgccgtcctcatctgccctccacatgaggcacaaacaaactcaaggcagcaggtgggtcagcagcggggccattaagctgagaaaacaccaagttacagctctgtctcctattcacagccaagtgtcctgacaagcaattcccaccttgtgggtgagtggcacctctataaaccctctgacagtttgggagacaaactccgccatcaatcagaatgtagccatcaggttcacttagagcctgcgcccctcgagccctgccaacccccctcccccaagtgcacacagctcagcagtcagcctcacatcttccggcttggccagaccctgcccagccctgccttgtgggtgagtgagaagcaaagccgagaatcctagcaccactcctcagcccagtatggctcccatggcaaacctgagaaaacgaggcactcccaaagtgccaggaaaagtccaggcttctccacacgtaaagcagcccagtggcccgggaagtctttatctctgcagtctcattgcctgccaggcctggaccaggtctctgtagtctggtggaacacagctattttggttcccagggcctgtgtgttttctcacgcccctaggcctttgtacttcctgttctctctgcctagaaaggtctccctcttggtctacagaacacattcccgctcattctgccagtctgactcttctcaatcatgccttttattcctggtacctgcacatagtagttgctctttaaatacttcctgaatgaacttgcttcaccattctctcaaacttcattgaactcatcctccgcttggcttgacactgaggacgttgtttcctgatctgattcccacgctcaaggtgctgagtacagatgagacttccctagataattctacaaaggggccccttccgtggtgcccacccaggctcctgtacactccaaagtcacatgtaggaccacgtattgtcactgctgctcaccagattaaaccctaagtctgtgatctaagcatcacccagcacagagctggccaagcccaccacagctgccacataacacccccgagcagtgatggctaaatgccaacggtgctgctgttaggtgctgggagccctgtgccagaggcaggtccaggcctgatcagctggtggcctgcagaaacctctctggccacaacctcacctctcagaccccatctctcaagtgggcaacaatctccttcttctccaaccacactgacaggatggagagcacgacacatcttgtttgccaaggaaaaggcctgcctttggccagagcagctgactctgaccctgatccccccctccagcagacagatgctgggagcctctccctacccctcaggtgttcagaacaggctgccactgccaatttcactcctgtgctgccccagccaactccaacctccttcccagcacattaaactttattttcttaatgaaatgtcacttgctgacttctggcagaatcataataaaaagaaacggccataaagccattttatgcagacagggcccccgccaaccggcccccctcccacacatactttgagaaggctccacagtcattttatgttctcagctgctggaatatcccaagccagtactcagaagcaagatggcacagagaacgccttcccaagcctctggctcctgctctgtgaagctccagagtaacaggcaagctgccacgcctgctgttactatccagagcagggactgccttcagaccccgcaagatgacccaaaacactcttcagtcaccggggagtccccttgttgtggctcagacccatgaagggctgggtgctgtccacaggcagactaaccctgatgatcagtgatgctcagcagtgggggcctggtctagggagggcaggcagttcaaaaaacacctcttccctccaagtggatacttagcaatagagagggagagggttaagttcataaatgataagcaaagcctaaattttataaaaatgacccatctctcataaactcatttcttcttgggtcatcgcaaagagagaaggaaaaaaaaatcagcgttaatttgatcaattgatcagatgatcgattgtgaaactggagatgcccactgactaggggcagtaacatcctggaacttgaaaccacaaaaaaggagccatcgatttcctcacctgctgttcccaacaaaaccaaagcccagggagaaaggcgtcctggggcctccagaggcccgtgctctccagaggaggggagaagcgggggtgcgcagcagcagcttccggagagttttacactggaattagttacagatgcagttacggtgt

SEQ ID NO: 64795 - DNA, 4873 bp, Bovine  19866880508188
tggaaatcaaggacttagaatatcaggcaatcttaaggaaaaggaacaaagttggcagatttatagtacctgatttcaataccaactttataaagttaagataatcaagactttattaaatgtagtacagaaggagacaagacaaacagaccaatggaacaaagaagagagaagagaaatagcacacacatcatcagtcagctgattttcaactaaggcaccagagcaactcaatggggaaagcaaagtctttttaacaaatgatgcaagaacaactgaatattcatacagaaaaaagtaaacctttattcctataacacttttagatgtaaacacaaaagaatatctttttatgcttagggtaagcaaagatttcttaggatacaaaaaacaccaaccacaggggactctgctggcagttcagtggctaagactccatgcttccactgcagggggcacaggttcaactcctggttggggaactaagatccagcatgcctcgtggtatggcaaaaaaaaaaaaaaaaaagtactaaccataaaagaaaaaatcggtaatttggatttcatcaacatttaagacttttggccatcaaagtcaccattaagaatataaaaaggcaagccagagactggcagaaaatattcacaacacatatctgacaaaaggcttgtatctataatatacaaagaatttctataatctataataaaaactgaaaaaaaaaggcaaatgtcttgaatagacattccatgaagataaacaaatggtcaataatcacatgaaaatgtgatgagcatcattattatcagggacatgcaaattaaaaccgcaatgagatagtgttacgtaatacccactagaatggttaaaattaaaaagattgacagtaccaagtgttgatgaagatgtgaagcaaatgcaattcttatacactgctgacagaagtataaaatgtacaaccacttagaaaactatctggcatttctcaatacagtatattctacaaactataatgtaatttttttcaaactgtaatatttttacaaaaagatctgcagaacaatgttcataacagctttattcatatatctaaaattttgaaacaatgcaaatgaccatcaacagaaaaatgggtaaatagtggtattcttattcaatggaatactactcagcaataaataagaacaaactagttatactagtaataatatgaatttgaaaaatactatgttgaacaaaagaaaccaaaataaaattatatgatttcatttatatatagttcatgaacaagcaaaattaacatatggtgacagaaatcagaatagcagttgactttaaaggtgggggattaactaaagtgaagcacaaaggaactgtgagaggtgatggaaatgttctagatttggataatgataacctagtggctcagatggtaaagaatctacctgcaatgtgggagacctgggtttgatccctggattgggaagatcccctggaggagtgcatggcaacccactccagtattcttgcctggagaatccccatggacagaggatcctggcagactacagtcccatggggtcacaaagagttgaacacgttgagcaaccgagccacagcacaatctgagtgtatataactgtcaaaactcatcaaactatatactcaatatctattttactgtatataaacataaaatacatttatacacagtaaatgggcactgtgtatacacataccctggtggctcagtggtaaaagaatctgcctgccaatgcaggagactcaagagatgagggtttgattcctgggtggggaagatgccctggagtaggaaatggcaaccctctcctgcattcttgcctggacaagaataaaaaactggctacaatctacagggttgcaaagagttggactcaactgagcatgcatgcaaaggaagggaaaggccatgtaaatatctgcattaattttttgctctttggtgcacagataggcagaaagtattaatatatctgttttcaatcaccagaaatagtaggagaaattttgctccccaactcaaacaagatggcaacattatcagaatgaattttttccaaaggacatcaattttagaatagtcaacagtggatctttctcagtttatgtgccacaaaccatgggggagactgcatcctcatatccgtaggcttgcaatataattttttttaaatttttatttacttgctatatcatttttaaaataattttatttattatttatttatttttggctgtgctgggtcttcattgctacacggtcttttctctagttgcagcaagcgggggctactctctagttgaggtactcaggcttctcatcgtggtgacttctcttgctgtggagcatgggctctagtgcgtgggggcttcagcagctgtgatacgtgggctcagtagttgcggttcccagactctcgagcacaggctcaacgatgtggcgcctgggcttagttaccctgaggcatgtggaatcttcccagatcagagatcaaacctgtgtttcctgcattggaaggcagattctttaccactgagccaccaggggaagcccattcatgttagttgcttaattaaaggagactaaacttccaaatactatcatgtgaaggagccgaaattttttaaagtttcttcctatttctttccactcaatctctcatctgcagagtcagttggtggtctgatttctattactatacatgaaaatgaaagtgaaagttgctcagtcatgtccaactcttttgacaccccatggactatacagtccgtggaatctccaggccaaaatactggagtgggtatcctttcccttctccaggggatattcccaacccagggatggaacccagggtctccccacattgcacgagggttctttaccagctgagccaccagggaagcccaacagagggaagccacaaagcatcactgcccgccagtgttgtgggggtgactgttggctaagatgcttcaaatgcagtgtttatataaagaaaggtataaagaaaatatttctgtctgatgtgtgagacggctatttaatttcttcataaaggattaagttacttgtaggaggcaagtaggcttggcaacagagtatctgagtgatggttcaaggcatagcaggaaagaagctagaagaataaaattcgaagccatggggatagaaaaggtagagaagaaaggagcgagaaattgacagaagtagtgaccagattgtacagctgtcagttaattaagaatttgaagcctgtcgtcatatcatcatctactttgggaaattctggttatcttttgtcttattttaggtcaaagaagaaagagagaaacctaaaaaagcatattcaattttcattcacccataaaaatattgtttttgatatggtttaaatctgtttgcaaagtctcccatttcagtatttttaaaaagttcattaaaaggtgttgaggtaagcaaatctgatgtaaaactattacaaacccagcaccgtacactattttctagatttttgctaaaacaatgtctataaacaagaacctacagaatgaaggcctgccaaatatctataatctatatatatctatatatctataattgttacctccagaaacaatttgatatagcaaagtgccggaaaagaaaatggaactatttcctttaaacctcaacttaatttttaaaaaataaagtgctgaaactcttggaaatgaataacagttactttgagtttttaagggttgcatcttagaatgttttcaagaccaagcatggtcacttattgtcagttcaattcagttcagtcgctcaatagtgtccaactctttgcaactccatggactgcagcacaccaagcctccctgtccatcaccaactcccagagcctactcaagctcatgtccatcatgttggtgatgccatccaaccatctcatcctctgttgtccccttctcctgccttcaatcttttccagcaccagggtcttttccaatgagatggttcttcacatcaggtggccaaagtttggagcttcagcttcagcatcagtccttccaatgaatattcaggacagatttcctttaggatggactggttggatctccttgcagtccaagggactatcaagagtcttctccaacaccacagttcaaaagcatcaattctttggcgctcagctttcttcacagtccaactctcacatccatacatgactactggaaaaaccgtagtttgactagatgaacctttgttggtaaagtaatgtctctgctttttaatatgctgtctaggttgatcatagcttttcttccaaggagcaagcatcttttaatttgtggctgcagtcatcatctgcagtgattttggagcccaagaaaataaagtctctcactgtttccattgtttcaccatctatttgccacaaagtgatgggaccagatgccatgatcttagttttctgaatgttgagttttaaggcagctttttcactctcctcttttactttaatcaagaggctctttagttcttcttcactttctgccgtaagggtagtgtcatctgcgtatatgaggtaactgatatttctcccagcaattttgattccagcttgtgcttcatccagcccagcgtttctcatgatgtactctgaatataagttaaataagcagggtgacaatatatagccttgacgtactcctttcccgatttggaaccagtctgttgttccatgtctgtttctaactgttgcttcttgacctgcatacagatttctcaggaggcagttcaggtgggcctggtattcccatctctttaagaatttccatagt

SEQ ID NO: 64796 - DNA, 1626 bp, Bovine  19866880582650
ttcagccaggtatctcaactatggcaggtctgatgattccagtaccagtatcattagaatggtcagacataaaggtcaggagatagggaaacctgagggcgctagagcctcagtgctgtgttgaagaatggctcacctaagcactagagagactctcctgcccaaacataccttcactacgctgtaggctctcttttgagtcggggtgagcccttatcctctacagctcagttttaagaactgttccctgcctagttcactgagggatattccaagggtggggtgccaagaggtttctctgctgagattagaaagaaagtcaactgtcccttccttcaggtcaacttgacatttgagcctctgggatcctaacagtgaaaaagataggtaactctggccttttcatactttaggcataattcacagtgctagtataagcactgtgaacttggagaaatcctgcgtttcagtggaatggaaagaaggaggagatacaaagggcaaagaggtgggttctatgagtgtgcctctactacagttaaaaagacatgtgtggaaatggaacttgtgtcagctttgtcttccatcctgacttgtcctccccaatcttaaatacggtcctctttgaatgctttgggactctttttaaggcagccttgttctaaattgaagcaatcaacagtttctggtgtgtttgtagaaagcaaactgcacagaattctaaaaccttactcacccaagctagcttctgagtgcacactacctatgatactgatttggagagtaaaattgataatctgtttggggagacaaaagtatgtttctgaaacacccaaaaatagaaggcaactacagatggaataatgctagagcaggtcagagatggaaactcactgcagatgagcttgtgggggtggggccaaagacactgaggtggccctcatggggacgggtaaagaaactggctccaggcgcagaggaaggcttagtatgcttggcagcagcaaaaagactggaaaaggagactagaaggcctttgtctctggcactaagatgtttaagatcttattctgcagccagtgggagccttggaaggattttgagaagtaggagggatatccctaagacatttatgttttagaggcatgtggtgtagtgaagaggtcaccaggctgagtacgaaaacctggattctagagtctggccctgccactaaatgttctcgagcacatttctgctcctatgagaaattctcctcgtttatgaaatgaggatgataataatatctactcatagggttgtttgaggacttattcaacaaatccttttgtactggttccaaaatgccagccagtgtgtttggtgttggggatacataggtgagtaagacaaacctggacccacttcatgaagcttaatgagataacaaatgtaaagtgcttgcttagcgtagtgccttatggtagacacaggtttatttaggtggtgtatttgagaaatagaagaactggattctttatattatgtccttgaatcaagaggttcctaaaatccctttcagccatctattagcagttcctcggacttgtttttgttgttgtttagaaatacaattcttatgcgtct

SEQ ID NO: 64797 - DNA, 1912 bp, Bovine  19866880600140
ttcactggaaatgtgagaagcttttaaaacatttctcaagctgtctggaaaaggaaaaaaaaaatctttattgaaaggatgtagcagtcttttttactgtggcctatttatctctggggaaaaagctgtaacaagaagatcccctgccgaccatcagccgtgtcggggcctgcctggctttggtggcaggactttggtgtggggggcttgctgagagacagtggggccacctttggcaaaaaggggaaaggctgctggctctggtgcattcctgcagaagaggcagcctcagcacaacaccgaacgcggtgctcagggctcagcggacacaactcgacaaaccctgtttgaatgaatggatgactggaccaaccagcaaaccagaccaacagagccctgaagcggctgccccactttggccgacctaataaatgtgctccgtacctgtgacccctgagtattgtaagcagtgacacctgtgcgtccacacgtgttctttggcctcccacgagcctcctgctctctgaggctatggggtctctctgtctttctgtcactgtcatctgctgatgacatctctcttcagggtacttggctcgctctctccctgctcacccctgttcctgcctccatcttgggaatgtccacacccacatggaccatccatatcccggattctcgactccagtctccttcactcctctggcagaagtccataggagcatggtcacacttcccacctgaccatctcccagaatttcttcacctcagaaatcccaccttccaaccagaacttttatccttgcatctgttccacttccttcactcccacggaatctgctttttgaccttatttagaccttccatccttgggccgttgctaatttaacaagcccatcattcctctcctagcttcacttcctttcttacccaaccttgaccctttgattaatctcttgaaagaatttcttcgttcaattcccttacccctgtgcctttctgccccacctatctgcctttctcagctccagagccatatcccacttgctttctcctccacttctagcctgcaatgcttgactaagaaaatcacacaaccagtcctcctggtatcaacctagccaggccctgaacacataccaccagctccttggcttgtcccacgatgaggtctctctttcatttcccagagcagttgttttaagccttttcctccctctaaaaaaatgtccttccttgcctctgtttacctcattctccatagatgactttatttcttgctttacagagagaatagaggccaacaggctcaactttctcccctctgaccctctccttggccctggtggttaccttccctgcttcactcactgccagtcctcccacggtttgtgcccatcactcctgccccttgagatcttgcaccatctcttccgttgtgtgttggttttttatattcattttgtttttggcggtgttgggtcttaatcgcagctcgcaggatatttctttgtggcgcacaggctcttcattacgacgtgcagctttctctctagttgaggcatgtgggcttagttgccccacagcatgtgggatcttcccagaccaggaatcgaactttcattccctgcattggcaggcggattcttcatcactgggccactgggggaagttcctcttcccttgtactttaaaactccccgcttcctatcagtacctttccttccaccttcgagcaccctcaaatctcccctttaaaccttcttttcatgttaccttccaaacacattactgtccccatgttcctctttctttttactgataaacctgttgaaaagcaatcttattcttatcccctctacttcccaatttccaattcacccagctcattgtagaccatggtctgtcccca

SEQ ID NO: 64798 - DNA, 1263 bp, Bovine  19866880651147
actttgatcttcataaggagctcttatatctttgtatcctcagaattcaatctgctatagcaaacaaaagcatcagtaaatactggcaatcttcttgttacctccttctccttgtttaaactgactcaaagattagaacatccaattttagatgtttagaaacagcatactttctgacagagctgactgtcctgtgtagaacttgtgactatttggagttaaggcagggatcacagaggtaacttggcagcttcctgaagcaatgaggtaggagacgaatctgctgcttccaaagaaaaggcagagatgtctgaaagcaaagaaatcagatgccattgtcctggacagcatggctagagggtgatatgccagatttataattttaaaatgcaggttcaacatttacagttataatatttttagctcattcacctttctacaataagttttcctcttcaggttaagaacaaacagaagaattctactcatctttcctatgcgaagctaaaaactaactgagaatgtgttaatttctgttaaatgagttctacataaaaatgctgattacatctctttcaggatttagatatctacaatttaattttaatctccaaatgtactgatattaatagagaaataacaaaggctttttattctctcaaatcaaacttttactttgaaataatttattattctgaatttataataaataacttcattctttttctttgtgtcagacacacatatgccacaggataaatgtatcactgccccatttcaagaccacagagtatgctcttacaattacattatgtattttctgcctgtaacttgaatattaattttaccctgaagtatatgacatagaaatagtgtccagtttacttagaaacctaaaagtttggaagaagatcagcagagggttatgaaagaggggcatttgtaacaacatgagaaacaaacaactatcaagtttaaacaaacaacaaaaaaaagaaactaaaatcagaattttatcatccccaaaaagtaacttcttttttttttttttttttgaagaaacaaaaagtaacttctaagattagacatgtttatttttcctattaattacacatgtgactttgaataagtcattccctctttgagcctcagtttcctcctttataagataaaagcctgcaccaactttaaagcccttcgtggcacaaaactctatgattaccagggtcaagctattatcaattctttatctagacccatgtt

SEQ ID NO: 64799 - DNA, 1524 bp, Bovine  19866880701814
cttcaccattccctgatcttcttttacttcaccaaccttcacttccttgcaactttagacacagtcacaccctttccttgtcatttaactacagacctctgaaatctttcatgtgccagcagctatgctagatatgatcataaatccactgcctctgcactcaaaatccttacagagaaatagagatacatccaaggtagagtgttttcacaaaccaggaaatgaatggttcagaagggaaggcaccacatagtggagatgcttgattagggtatttagggtgagtagggaggagaagaaaggcatttgaggcagagaaaatagcatatactaaggtctagagctataaaacaatatggcttccaagtacaaatggagaaagatggaagataaaactggagaggtagacaagggtcaggtcatagagggccttatgggtttgaactttacaaaaataataaccactgtttatcaaacactcagtatgctttaactcattgaattctcacaataaccctatcgagtgtgcaatattatttacatatgacatgggagacatctccctttctcctttgagtatctccatttaactatttagtctcttttcctctcactctttttcccccatgccctatcctacaccagagtttttcacattcctcgttcttatatctttatgtctttgctcatgctgttctaacagcctggaatgccttccccttgatacactgcctgaaaaaactctattcattctttaagactcagttccagttcccctctgatggaacgtctcctgaaagccaggtgtcagtccccacctcctgggtgggaagatgctgtctctcccaaagaccttttggcaagttgtttttcccaagagcttctaaagagcagagccacatcggagaggaataaatgtttatgaacacagaattagaagtaatcggatttgaaatgaactcatttgcttccagttctcaaacaaccttttctttttcttttatagccaaacgagtgaatgtgatcgtggggaatgaccagttcctggagatctgagttctgagcaagtcagactccttccttttggcccccagaactacagatgttggctggcccacctgtttgactctgtatttatttcccaataaaagaagggctcccaaaggcattctggagacttatggagtagttgggctccgaggatacagtgtatgttcctgttggaaaaactgtcaagagccagcgtgtgggacaagataggacacgtggcctggctcttatacaccaaggttatcaggcaggggcagcagctgtccagtggtcaagctcccaggagggctactttccaactggctggcccagcctagcccttaaaagcatctcccacctgaaaggacttgagggtccatcagcccccaaccctaatcaggctttctagatctgtgggcctagttgctgccattgccacctctgcatgtgatgcgcctccctgcagctgccagtgtgggcagcctcagccccaga

SEQ ID NO: 64800 - DNA, 1747 bp, Bovine  19866880705637
caaggtgagaaacaggcagccaattggatccaggggggtggcccacccagccttctaggtttgtgatggttgtggttcccctctgcaacagttctggaaataagcaggtcaaagtttttgagagggataaagacacactgctctctgtccctgcttggtctcttcataagtctcctcatcagtctccttcaggtggtggccctgagactcaaagtaaagcttgccttgggttgaggagactggtaaccagctcatcagccactatgaggccatgtggtatgcatttgggctgcctgccaatagcacacgtatgtagacacagctttacagtttaaaaagggtcttctcataccagatctcagtggatccaactgtcctgtgcgagaggcaggccagcattattattcccattttacagataagaaaactgagatttatagaggtaaagacagggattccacacagaaggtagaatgacctggaatcccctagcccctgccacaccaggaaactgaatgaaaattaagtcctgggccttgtagtccctgagaaccccatcagcctaagcagttgagatggctcctgatcactatacctttcttctgatgcttgtagatttccagctgccgctgctgctgcaacctgagagtattgataatggccactgtgagtctgagggcctcttttgggtaaccatgggaacgcagggcatcaacccgagcacaggctgtaggcacatgctctatcagatgagaagaagatattttgattgagttaaattttcaaatcaggaaaatttgtgtttgacaaagggagactgtattcagttcaggtcctcaaatttgatctgacatctattgtgtaccagaaattgtattttatcttttagggataagtcacaggtactacctccaaggagatacactgcagcctcagcgtagtggtttggtgtagaaaggggcaaagaactaggataataaactgttatacctctttctgaacatgaacctcaggaacctaatgcagcaataaactacttttatagagggaaaggcctcacttgtttattaatcctgtttcctgagaacctattatgtgcaaggtagcacgctgggcaaatcaactacaaaaatgtataagaaacggtcactatcctcaaagagctcacaaataatacataaaaagatcattataaaccagttaaaaagaaatgacaagatagaaatatacacagaaagaaaatatttgaactgtgtgctttatagggcaagtaatattttaaataggtagaaaaatagaaacaggcatccctggcaaagagaacatctaaataaaggcatgtaagtaaaagcataaaaagtattctggataacatcttccgagtatggcaaatagttttgtgtagagttaggttatgtggctagagacagcctggaaaggtggagtctagaatgttaagctttgaatgccattctaagaagtttggatttaccttaggcataatgaatgactaccaaacacttataaatggggaagggattaaaaattataggaataattatagaaaatacagataaaatagaaaataaaaatcagagataaccattatttctaatttcatattttatgaaaaatatgtatctctagactttcctaattttaataaaaatgaagtattataattattgttttataattaggtttttccacttaataattcattttaaatatttttccataccattaa

SEQ ID NO: 64801 - DNA, 3360 bp, Bovine  19866880723380
gttagcacaggcaagaaaggacttcaggggaagactgttgaggcaaccgtagcaatgtttgaactgggcggtagcaggtgggatggatgagaggagagtggacttgaagggtatgctgaagacggagactccagggcttcaagatcgactggaagagggctgaggggcaggaagaagcccaggctgccttagaagttccagctttgtggtgccagcggggatcaggagtgatgcccgaggcctctcttgcctgctcacagccagggctggtgcgtcaacgattctgaagcaggcactccatctcggggtaacatgatcctgtaacgcagggctcctctgatgtgggctgcttgccttttacagcattaggggagcaacatttcatggaaaattcaataaatccccctgtacagccagacgtctgtaaacaatggcttccaaattcaatcaggctggggacccgcagcagcatttatgagctctaacgtggaatattatataggggagtgagtagcagggggctgggggaagggacttcctggaagatgaaagctcccgtgtggttcctgctttccgatgcttagagtggagtgattctccaggtagaagtcctggctgtgggaactcctgggctgggcctgaggccattgagctgaggctgtgggcctggggagaaggatcggggactgggcctctgctactgactgtcacaaggctgaatggtcacagtcagcagggctgcgagggagccccgcaatgccccccacaacctgcaggagacgcccatctgagatgcctgtgagttgtcaccacgtgcttactgcctttgtcatatgggaaagccctatagcttcaaaccgcttgctataaactttccacctctttggtcctttggcctggtgatgatcttctgtcaggtccagactgcccttcacctagtgcagaacgaggtgggggcaaggacacggactagcattttgagaggtgttctgatgaggggctgcagcgggctctgttggggagccttcgcgctctcctccactctttaggcccctttagatttctccactcctctgcccttcgagcacctccagactctcctggaggtgagactctccagacctcctcctccaccgctgttgcctacgaaccgtctggcaggctttctccagcaaaccaaggtggggctttctggggcagaggaaacaaccaaggctctgggtcaaaatccattcttgtcatttaccagctatggatcttggataagttacttccttctctgaatctcagcatccttatctatctgggggaataacgttaaatgctttgtagggtgcctgtgaggatgaagttggacaatgactgtcaagtgcctggggttccagtgtgaaataagccagcaaaacatgcacactagcttccttctccacatttctcctcctcctcctctcaaaccttcctgtaagaaaggttttggtgaatcactgggagctgccctccctccaaccaaatgtaccagatgttccatcagctctttgctggtgtcctgaacatctcccaggctctctttgtgattcttgtgcatgcctgataaaagagtccaacaggaagagcatcagacatcacaaaaggccctggccaccctgagaggcacaggtaagaggtggaggcacctctggggtgccttgacactgcaatgcctttcttatagacagaatgtaagtttcaggaggacaggagtttccacctgctttgtttatggccctattcccagtgcctggagctgggcttgacatttggtaagtgttcattaagtacttcttaaatgaattaattacttcagctcctctcaccactttcctctggtttttctctggtcccagggggagaacagagagtctgccttccagaagaacaaaccacaaaccctcctgaaagtcaggaatcctctcttccctctaaatgtccttggaatgctggccaggcttctccccatggagcgagtatggagcagagtcaccaccagaaaggattctccttgccacccactgctggaaacccgggtttggggagaaggaggggaagagggtgatttttgcagaagaggttttgtggagatcctaggctggatgcagacctttggagatggtgcaattctaagttttgtgaacgtgaactggatacacactcccctcccttttcagaagactgttctatagcctccccccactccttcaccctgccccagtcaatttaagacacagggcaaaagggagaaaaaggctggctacccccagaacaaccttaagtagcattttaaaggattaatcacacatcaggctctgcgctcagaacttcaggcatcaactcacatcagcctatgaggaagggacagtgttatccccattttatctataaggaactcgaggcttagagaggttaaataacatgccaagatcacagagccgagaagagggacaggatgacgtcccaggtctgagcgatgaacctgctgttgcttcggaaaaaggtgatggagggcaggcctggacttgaaggtttctggggccctggcagagaccaagcattctccatctgcccccgctctgtcctttacccccacctcctccagttcacagagggcaactgaggtcgtttgggagaagctatttcctttgggccccttgacttcctgctgctaggccctccctagggaagcgaaaggaggtgggatggggttcagggagagctactggagagctgctgctccctggtccctgctacagatacgagtgggatgctcagccgggaccagttccaatcaactgggcatacttgcaagaccctgttggtagtttcgggtttgaggccaccacttgctccactgcttccaactgctcagtaatcctatccaactggagggaggagaccctttaggatctgagccagcattgagcttttggttgtccatttggctggaggcggggaggggatccaaggagacagatcccaggggtgagatctatctctccacagccagacacccagcttccagggctctgggatttattccctaggcagtcacacaaaacgcctgtttccccaccccgccccccccacccgcaaataactgacagatgatggcatgtccccagcacaccccagcgacatccccacggacacgcacactctgcctccacgtggacttcggtgactagagggctctgtgcgcctgctctctctctctctcaactccccccagcctgcgcgctctcattctccctgctagctgctgtaaggatcagtccccaaagaaaaatgcccaatttgtcatgtcatgtccagctgttaacctcccgt

SEQ ID NO: 64802 - DNA, 1539 bp, Bovine  19866880748175
tcacatcaggtggccaaagtaatggagtttcagcttcagtatcagtccttccaatgaatactcaggactgatttcctttaggatggactggtttgctgtccttgcagtccaagggactatcaagagtcttctccaacatcacagttcaaaagcatcaattcttcagcgctcagctttatggtctaactctcacaaccatacatgactactgggaaaagcatagctttgactagatggacctttgttggcaaagtaacgtctctggtttttaatatgctgtctaggttggtcatagcttttctttcaaggagcaaatgtcttttaatttcacaactgcagtcaccatctgtagtgattttggatcccaaaaaagtaaagtctgtcactgttttcattgtttccccatctatttgccatgaagtaataggactgggtgccatgatcttagttcattgaatgctgagttttaagctagctttttcactctcctctttcaccttcatcaagaggctttttagttctttgctttctgccataagggtggtgttatttgcatatctgagttattgatatttctccctgcaatcttgattccagcttgtgcttcatccagtcccttggactgcaagatcaacagtcaatcctaaaggaaatcatacccaaatattcattggaaggactgatgctgaaggtggaactacaatactttggctacctgatgtgaagaactgactcattggaaaataccctgatgctgggaaagattgaaggcaggaggaaaaacggatgacagaggatgagatggctggatggcatcaccgacttgatggacatgagtttgagcaagctctgggagtttgtgatggacagggaagcctggagtgctacagtccatgaggtggcaaagagccagacgtgactgaactgaactgacttattgttaacttaaggttctgattgttaacttaagataagaaccaataagatgaaaaatcagttggaactattgggaatgaaaaatttaatagttgaaatccatacatggattgaatagcagaatagttatagccaaaatgaaatgatgagcaataagatcagggtgatgattcatccaaaaggcattaggaagggataaagaaaacaagaaagatagaaaacaaatgagctcattgtctgtgacatacattggtggtaatcccacagtcattcccagcccccttctcccttactcctctccacattggagattgaaaaagaagggaacgcaatgaggatcctttccttgttatatctcctcccctttttaacttgccttgtatgtggatgttttgtctggagctgtgacagctttcttgtgatcatgaggtaggttgctagtcatcaattcaaaaaaactcatcatactcaggacaaccaagtaggaaggcaggaagagcccaagaaggttcttggtggctgaacagttgaactaatgccagcaaccacctaccaatcagattcctcgctatgcaagtacaaacaaagcaaaacgaaactcca

SEQ ID NO: 64803 - DNA, 1191 bp, Bovine  19866880864138
ccaggaatgcaaactcatttagagactgtggagcaagaggaagaggatgaccagggtgagcagtagggctccctggacgcaacctgctccggtctgctctgctcagcttccctccacccaagtagttttcaagcattcagtacaggtaggtcaagtgagctagctacaatgcatgaagccagaagtgtggtgagcccagtttacttaagggaaaaaaaaacttttcatatcttaccttggcaaacattgaattgagttgctttccagagccatagtaaccaccctgggagagaaagagcttcacttgttctttcacctgttcttcatccaaatgccaacagttctcatcatcaatgctggccccagctgttgggtcaggagcacctgcgaggaatagggtggtgaaatgaatctcctgagttcctacactccacactcagcaggagcagccctctgtgagtatattcagaaacagacaggcattctgccttaatctgggctttgtcaattgtgtggctctcaataaacataagagagtagagctagtttcatgttcactgaagtctcagttgtatcctctcccaaggtctacgaatatcatcctggggtaaaaatgcacaaacacaaaaatagtgatgtattttttttcccctaggagaatgtaatttttcttctattttgtttttctttgaagtttaaaataagcctaaagcacacatattattttaaaattaaaaaaatactttcttagaaaataaaaatttctctttttaaaattcactataaaattgtagcttctcaagtggagtcaacaattctaaatttctggaaacttgcaacccagagcacaggcagggttgtatacagggtgatgttttataaatttatactcagaatatctttccttcctgggctcacctcaatgacatcacttaaaacacagtgttagttatttacacatccctctcccctagtagcctgttagctccttgctcacagttgaatcatttataacacagttctggtaatgtgacaggcacctaagaaatatctgtggaatgaaaactgaatcttcttctctcactttctcaaagactgagtcctgtgataagtttttagaaccctgtctccaagtgacaaaagactataagtcagtatagtcttatagtataagtcaatactctatatgtg

SEQ ID NO: 64804 - DNA, 1131 bp, Bovine  19866880882080
ccttaggaggtagttggcccagttgtttagtcccagtccctgtccatgcttctgagaaatcccaaacaacttggaggctcgagaccccatctagtgcccaaagccccagcacaaaactctgcgctgagaggcttcacttcagctagaaaacccaggggcagatctgagactcctgccttggagcaggcaaaccacaggctctgttgcttcatccttgtgaggggctaagagcacctgcagaaactttcaagcctctgacctgggggaaagaagggatgggaagagacctcaaatggggtctggccaccggggttgcccccctagccctggttactgcagatcatctcagggctgctgaggagggagagcttgtccctgctggccaagttctcaccccaaatggtaatctgagtagacctggatcaggaccgggaggcccatggctgagcacaggctctccttgacaggtgtgcgggccctggtgagcatcttgcagagctggtacacactcttcacccccaccgaggctaccagtattgtggctgctacagccgtctcccacaccaccatcctgcgcctcagtcttgactatccacagcgggaggagctggccagctgtgctcgcaccctggccctgcagtgcgctatgaaggatccgcagagctgtgccctgtcggcccttaccctctgtgagaaggaccacatcgccttcgaagcagcctatcagatcgccatcgatgctgcggctggcggcatgactcactcacagctgttcaccatcgcccgctacatggagctccgtggctacccgctacgtgccttcaagctggcctcactggccatgagccatctcaacctggcctacaaccaggacacccacccggccatcaacgatgtgctctgggcctgcgccctcagccactccctgggcaagaatgagctggcggccctgatccccctggtggtgaagagcgtgcactgcgccacagtgctttcagacatccttcggcgctgcacggtgactgctcctggactggccggcatcccaggccgccgcagctcaggaaagctcatgtccaccgacaaggctcccctgcgccagctgctggatgccaccatcaatgcctacat

SEQ ID NO: 64805 - DNA, 1068 bp, Bovine  19866880914534
tgtgaagagttgactcattggaaaagactctgatgctgggagggattggggggcaggaggagaaggggacgacagaggatgagatggctggatggcatcattgactcgatggacgtgagtctgagtgaactccgggagttggtgatggacagggaggcctggcctgctgcaattcagggggtcgccgggagtcggacatgactgagcgactgaacaacttctgtacgtggtttgtttgtttttgcctcctctcttcccacattggcctttcctctcatttggtttataattactgggagaaactggataatgatcaccagtgccctgagaaactggataatgatcaccagttactcctgaggagtaaccaccaggagcaagtctaaatgactcaagagtcctgtcagcagccaggctggggagggatcattttcccaaacattttaatcacactgctcctaggatgggaagcctgacaggatagctaacagattcttaaagattcagctggttgtactgagactcactgggagcagggaagctccagaaggttgaaggaatagcgtttcgggctcgataggatggatggtggcttaaaggagagtagtagcaatgggggtaagtggtagtagcaatgggaatggagtggggagattgatcaggtagaaacttcggaacttgggtctggaagacactgaaatagacaacaggattgagtatccaagtacacaggacaatacggcgacacatgaggtgcgcttagtccagaacttacggcgaaggctggtcgagggcggggctgaaggtggtgggaagctctgtccgctggttcggccgaagctcctccgcccggatcgcccccgggcttccctgggccacaccgccatggctggcccgggtccgggcgcggcgctagagtccccgcgacagctgctgggccgtgtacgctttctggcggaggcagcgaagagcctccgggccgggcggccgctgccggcggcgctagcttttgtgccccgcgaggtgctctacaagctttacaaggacccggcgggaccgtcgcgcgtg

SEQ ID NO: 64806 - DNA, 1310 bp, Bovine  19866880928318
tgttgggtgagtgtcccaggttgcaggggggacccctcctccagggtcaccggtgcactggccctggggatctatggatactggaggccccaggacaggggcggggcatgaccaacagccctgtgagatggctaatgtggagatggtccttgtgtgtatcacagaaatgcactcaagccaagttttccccatttaaaaatctcttaaaccctcatcacgtcttacacttctgtccccttcactgtctcgctgctcgaaggtttatttatacttaaccagctcacttcccacccctggctcactgctgccatcatcctacttccccattgaatccattctcttaaaggtcattaatctgaatccccaagtctatcttagtcctctcccttcccagcatctcttcagctaacctgctggccacctcttggacaccctcctctctctccagtaccatgtgcctaattctccttacagacatctccttctctggctctttgccctcctcccaccggaaataaaagtaggtgttttctagtgttctgtctttgaccctcttctccccgtgcacactttaatctgatgatctcatctgtccctgcagctgcagctttcatctttatttagaggactcctgaatatgaagctccaaatctgacctctcgctgctctgatcccatttttccaactgcctggtgaatatcttcagtgctctgtcccacagacattgcgaaattgaatccatcatctagcccccaccccatcataattcaccttcagtggtccttatttctgttgatgacatgatcatcctttcaattacccagtcatgaaatcttgaagtgatctttgctgtagatgctctggactcataaaaccactacatcctgtgtatctccaccttgatggtcaaacctgtcttttaacagccattattatgctttaacacacacacacacacatacacatcttcttctcttttctttatttctcagtgtgaacaccatcactcttcttccaggctcctaaaccagaaacctaggcatccttgttagattcctgatcatcccttttatatgtccccttgtccctagttcctgctactgacttcgttgaggtccccagatgtctcacttatattatctaaaaatcctcccaattggtgttcaccatccagtcttctaccacccatcctccaccccactgctagcgtgatcgtgctaaaatgtcactccagtacctgcctacaactcaccaaggactctgattgctcctaggataacatcccagctccctaaggccgccaagcgtct

SEQ ID NO: 64807 - DNA, 4514 bp, Bovine  19866880934384
ctgctttcagaccactgcttctccacccagtggaccctgagggcaggtaccaccccgcacccctcatggttcttatctgccttctccacatctgcctaggactttgacactcacctgttacccaagtgacacctgccctgatcttgtcagctcctgttgttttttccagtattccacatcctcctggaggaccttgccaacaaccaaaattgttctgtgaaagaactccctcgcccccaggcctctcatggccttggacccgcccatcacactctctctctcctcctcatatctccccagacctattctctctctctcctcctcctatctccccagaccacttactcatggcttctagcctggaccccagggtgcgtcacttcaacaccctcttgccaacatactcaacctccttgttgcctctgccttctccacaacccagctattctcctctctgtctcagacacacaggcggctaaacgcagctggggagaatcacaaaaccacgcagagatgtgccaataaaaattcacagtttccaatctcagcactgctaagcaatccttttccatgcccttggtcagctctgtctctccttttccacagagacaatccaataatattttattattttgagtccccctccccaccttctgtccctctgtcttactaggtggtcttactgcctatttcactcagaaatttgaagtccttaggcatgaattctctccttccagacccaaaattcctttcagtttcagtgcaagaggtattcaccctcctgtttttgcttaatctcttctcctggacttagaatcccattccctggggaagctgtcctgttctcccttctctcgtgcatcttcccccttcccttctcatgcttccctccatcagcacatataccctgtctcccccattacaacaataccaacagcatcctcccatctcttccatatggaagctaatgccctttctttccactttccttttcacctaagatgctccgacgctcctttctctcccaaacacttctgaactcatggcagtctggttttcacccctaccaccctactctcaatcaatctgttctcagtcagataaatccttgatggtcatcatttgccaaatatgatggaactgcagctatatccattcattaatttgataaacatgtattgtcttccatgtgttaggcattacaccaaggcctaaggaaaccatgagctctgtgtctttatggagcttgcaaggtggaagtatgcaataaactaattacacaaatactgtaacacggaagttgtgtcaaagagaggtgaacagggtcacgtgagcctataaaatggagatttgccctgctcagaggaattcagaaaggtttctctgaggacctgacacaagctgagttgtgatggataagtaggagttgaatggatgaggagggaggggaagtgataacactgatcagatgcttactctgtgccaagcactgtagtattcctcccttcccttcattttataaatgaggacagagaggtgtaagaagttctgtaacttgccatgggtacctggtaagaggtggtgctggactttccactcaggcagtgccatagtggagcccatgctctccaccactctccttcccctgatgttagctatcatcctcaccatcatctgcttctctccctgcactctctgcgtgatcgctactgtggtttaatttcctccattcgtacctccagtcctgacctgtatatatcagtgtggaccaggttctctacttggatgtcccacaggctcttcagcctccatgtgccctgaaacgagactgatcttcctctagacccgctctcctcctgctttttcaatttcagggtatgacaccaccatccgcagaactccctcaatcggcagtctagactcttactcttaactcaggctcctacatgcaataaatcaacatcgtagctgttttcacctcctaagtaccctcaaaccatcttcttttctccattgccctcgttcagatatcatcatctccagtctactcttatgtttcctaatgcatctctctcccctctaatccatttctatctctacagctagaaggatattcctaaaacacaaatcagatcctatcattcagctacttaagatccttcagtggctctcaaagtccacagcataaatcctgaactccttatcagacagtctctctccagtctcatatcccctccagcaacgctgtgtgctatggctgggcaagacctagctctccacttattattctcactgccaataatgcccacaacatccgtctccccatgggcaacctgtaactcctattaagatcacactcagacaatacgtccttgccggaagctttccctgatagggaattcctcttcttcatggtatatttcttatatgtctacacctctattgagagttggactatacagaaagctgagtactgaagaattgatgcttttgaactgtggtgttggagaagactcttgagagtcccttggactgcaaggagatccaaccagtccatcctaaaggaaatcagtcctgggtgttcattggaagaactgatgttgaagctaaaactccaatactttggccacttggtcacttcactttggtcagtgaggagctgactcatttgaaaagaccctgattctgggaaagatcgggggcaggaggggaaggggatgacagaggatgagatggttggatggcatcaccgactcaatggacatgagtttgagtaaactctgggagttggtgatggacagggaggcctggagtgctgtggttcatggggttgcaaagagtcggacacaactgagcgactgaactgaactgaacacctctattatggcacacatcgggtaatattgcgattgtctgtttattcagtctcccctggtagaccttgagctttttgagggcagggaaattatctacatcctggtatactcaggaccctgaagagggtctggtacagagtggtaatgactgttgaatgattcaatgaccaagttaatgcaggaggacttgaagggacagcagggggatgtccggaggggaggaaaagatggggtgggtgggggtgagagaggatgaaagaggggagggaaggcaatcgaggtgatgttgaagattcgttctgcttaaataaagcctggcttcatggtcaaagagaagcagaagctgcaagggtttcagaaggcagaggctccataactgctgtcccagaaaaatactaagtgtttgtagacctagtgggaagagggtaggcagtagctacacaaaccagccagctagggaaatcccatgtctagaaacaccgacagacagacacccccaccgggacaggcagatacctggtgcttccccatcacagagccctctgcagcccctgtgctggcccaccacccgacccggaaccctgctgctctctctctctcagcaatttccctacccaagaaagctctaagggtttcaattaccggcgcgtgggatttagtgccctgggctctctgactggaggagatttatttgaaggtttagtgtcgtggagaattcacgtcttcactcccaggagcccagcttccgtcctgagcccctaaatcaggaaccaagatgggctattgtcacttaccgcattatcctcgttagcggaccaggaggggtgattaatagcaatgcacacacagccatcttgctcgctggccgctctgccgctgtgcgtgacctggggaggggctgagcccgctccaggataactaaggagactgggctagagcccccgcctcagccaggcagggcagcccctgtggtccttctagaactggggacagttcaaagcaaacttcgccagagagagcccagctggaaacctctgggcctgactcatggaagaggacagagggtgggtgggtgtcagggagagagaaaggggtgggtatgtttattatatgggcttctctggtggctcagacggtaaagaatccacctgcaatgtgggaggcctgggttcgatccctgggttgggaagatccctggaggaggccatggcaacccactccagtattcttgcctggagagtccccagtgaacagaggactcgggctacagtccatggggtcacaaagagctggacttgactgagagactaagcacagcacacatgtttatttcagttcccaagtgctctttgagtgcttgtgacgggggccagtgtgcgtgggacacaagggcacacggagagagggaggtgtagggagaggggtgaatggtgcagtttctatgagagtgggagtgagacagaggggtgtatctctgtcacgagacagagaggaatatatgtgcgagagggaatgtgcttctaaggagagagacggtgggagagagaagagtggttgtatgttttcttctttcttttgtctccgcaaattctcccctccatacaccttcccctcaaactttttggagtcaggctcaat

SEQ ID NO: 64808 - DNA, 706 bp, Bovine  19866881010415
tcttttttttgtttttttttggtttctgtttacggtcttcctgtggaaattgtttacttaacactttttagaaatcaattttatttataatcttttgagtttatcttttggcaaagcctttttagtggtttctttgggtgttgccttgtatatctaatttttcacagtcaactgatgttgacattcaccagtttaagtgaaatatagaaactttgtctccctttacatccttttgtcctccccccatttataatataattgctttaaatattttttcgacatccatttagaaccacatgagacagtgttataatttttgtttcagttatcacacctaatttagagaactcaaagaggataagaaaaatgtattatatttacccctatttttgcttgctgtgctttttcttccattttgatgttccaaaggtttttcttttgttgcttcttttccatttagagaacttcctttagccattctttaggttgggtgcaagcaacgtggtcttaggttatcttcagttgacaacgtcttgatttcctattcatctctgaaggatgttttcattcggtgtaggattctgggttgagttcttttctttcagcactttgcttctggcctttggtgtctggtggagacaatcagaaatccactgtcatttgaattgtttctctcatctgaaagttggcgtttctctttttgcgg

SEQ ID NO: 64809 - DNA, 1011 bp, Bovine  19866881012182
accgctatggccgcgcccgtccgccgtctgtgtcatatcgccttccacgtgccggcggggctacccctcgcccgggatctgcagcgcctctttggctttcagcctttggcagtacgggaagcagacggctggaggcaactggctctgcgcagcggcgacgctgtctttttggtgaatgagggcgcggggcccggagagccactgtatggcctggacccgcatcatgggatacccagcgccacaaacctgtgcttcgacgtggccgacgcgggcgctgccgcccgggggctggcagcgctgggctgcagcgtgccggtgccccctgtcagcgtgcgagatgagcagggcgctgccacctatgccgtggtaagctcgccggcaggcaacctcagcctgactctgctggagcgcactggtttcggtgggcccttcctgcctggctttagccctgtgccctccacacccggcccgggctggttcagccacgtcgatcacctgaccttggcctgcaaccccagcagctccccaaaactgctgcactggttccacgactgtctaggctttcaccacctgccactgagcccaggtgaggatccagagctggggctggaggtggcagcagggtctgggcttggcgggctgaggctcaccgccctgcagggccctgtcggcagcgctgtccccacccttgtgctggcagagtccctgccaagggccaccagcggacaggaccaggtgggagcagtttctggcccggaacaggggacctggattgcagcatgtggggctgtacacacccagtatcaaggaagccactgaaggggtggcaggggcttgggggtcagcttctgactcctcctaaggcctactaccagcagccaggcaaggaggagcagatcctggctgcagggcaggagcctaacctgctggcccacaggggggtattgctagatggtgacagaggcaagtttctgcttcaggtcttcaccaagtccctgtttgcggaggaca

SEQ ID NO: 64810 - DNA, 749 bp, Bovine  19866881015706
acatgtgtttttaataatttgtaagtaaacgtgtttgtgccaaatatttaataagaaaatcatgtggcttttctccaatgttagttgttttcttttgaatactagtcgaggttttttactggaaggataatgaaaatattaaaacaagcttctaaacgatgtcttttaaaaattgaataaaatattcacacattcatcttggaaaaagacaggaacttaagtcaaaacctcaaggatcatggccacatctctatttctgggactacagatgaagagaaatgggttcacattcttgattattttgctgatggtgtggaaagtcttgaaatgcgttctgtttatctacattaggatccccactgctactaaccagctgaaactcctcaagtactcctctaaactttctagtgggtaaaagctatgctgccaatttctgatcttttcagggcttctgcagtacaaatcaggtgctcagctttctttatggctggtttagaattcagctttcttaggtatgctaagtctgttaccactatccttctttacagcttccaaaatttagttactttcttctcctggtctttgtccttgggtttgtagggaaagagtaaattagccaagatagcagtggtcaggcgctctcaccccacgttctcttgctctcaccccatgttttgtaaataatgactttgcatggttactaacagctgagatcctttgtagcactgcatgcacctatcaagcccttg

SEQ ID NO: 64811 - DNA, 780 bp, Bovine  19866881063690
tgctggggcatgaagttaagggtagaatacagaggtttgtctctttgcgggaaagatgccagccctgcacttccctcttctcgtctaggtgttccgcatgtatgagggccaacagcctggcacctgcaaggtgagtctcttggccctcacccagccatctctccccagggccaaatctacaggttttcagtgagttaagtgatgcatgtttgggtgaacagtctccatgacagttcactggggcgagaggaatagttcttgacctgaagaccttacaggtagagaggggacaggagcaaatgatggagacagtagtgtcacagtgtgtgaaatgtactcagttttgtgggatatgaagtggggagctatcgtatctatctggaagaatcaggaatggatgcttggaagaagcagctggtaatctaggtcctagaactaaattattttctccaggtttggaaggagaatcagcagtaaagatgttctttcctggcccaagagtagtgtgagccaaggtgaaataccatacagcctgtgagctgttggattagttggagttagcaggactggcccaggacagttaaggccgtgagcactaggccctgaaggattttaggcggagagaggagtcagatttgcctgtcaggaagactacctcaggctgccttttaaagaattgattgattgaagagttagatactggaaacaggatggaagctttacagtattaaggctagaatctgagctagatcagtggtacggggagggccgaggtggaag

SEQ ID NO: 64812 - DNA, 1330 bp, Bovine  19866881090790
aatagggagaggactgactggtgtcagacaagtgactggcccctgttcccagggtggagatctgcccagtgtggaagaggtggaggtgcctgtgcccccactcctactgcagtgggtcaagaccgatcaggccctactcatgctctttagtgatggcaccattcaggtaagagctccgcctggagttgggggtgaggactgggaggtccagggtgctggggaggaaacgatgtgggccctaggccctgatcagtgccgccctcctgtgcacaggtgaacttctacggagaccacaccaagctgatcctcagtggctgggagcccctccttgtgactttcgtggcccgcaatcgcagtgcttgtacttacctcgcttcccaccttcagcagctgggctgctccccagatctgcggcagcggcttcactatgctctgcgcctgctccgggaccgctgcccggtctaggccagagtctgcaggcccggccacctctcaagccctcaggcctgaggtctgtgcctctcaggctctggccctcgcctttgtggccctccctgttcctttggtgcctcactgggggctccgggccgaatcccccagggaatcagggaccagctttactggggttggaggcggcctcccaccccttctccaagaaaagcctgagccttagccccccactagggggcgttatttatggaccacttttatttattgacatttatttattgggatgtgagccccacgaagggcctccttctgggataataaaccgtttttgcagaactcgagggcctcctcactcgcagtagagtccgtggaccgtggccacggcgaagagcgaggcgttggtgacggcagccgaggccaacccgtcgcacgcggcgtcccagagcgcgcggctgaccacgcggacgccctggcccgcgcgctgccccagcaccacgctgcacaccagcttgtagcgcggcgggctgagctcgcgcaggcgcctgcgcaccagctcgcacagctcctgcgccagccgcccggcctccgcgcctgagtagcatgcgtcccgcagtccctcggccaacgctgcctccagggcctgctgtgcgcgcgcagtctcccagcgctcccccggcgctggctccgtgcggtacgagggtgccatccggcgggcgggtgccaggggcaagccagagaagctgactcgcgagcctagagggggcacggggcccagggatgggcgtagacccccagggcctgcacttggcccagccagtgagttgcggtgtgaaaaggacaagaccggacctagcacggagccacggcgggaggccgggcc

SEQ ID NO: 64813 - DNA, 972 bp, Bovine  19866881126857
tgaccccatggactgtagcccaccaggctcttctgtcctggaattttcccaggcaggaatactggagcagattgccatttcctactccaggggatcttcccaacccagggatcgaacctgcctctcttgagtcttctgcatggagcaggcagattctttactgcacaacctgggaagggctaccactgcggggcggggtaataattattaactccattttacagacgaggaaactgagatacagaggggttaagtgacttctctaaggttgcacagcccgtaaagtggtaaagaaaaggggtcaaaaccaagcaatctgactcgagagcccacacttttaaccactccccttcccctcaacaacacacacacccaggactagcctagaacagagaggggaagcaacatccttctgcagttgagttccacaccttggctatgcaggagtgcttctgggtggaggacttcccaacagaaattgagaacagaggcagagatgaagggacacccgccccgccccgcgcaagggtctggagagtgggggcccgagctctttctgcctcctcactgggggccacaccacagcctagcccctgtggccccatccacgcactgcccagggcatccacttgtgcccacataagtgttccacccgctcccgtgaccctccggcaatccctcctgccccacagcctctcagagggtcccctactttcacatctttggctccggtccatttctccgctccccgccccccagccttcacgggtgccccagccctcaccgttagctcacgcgtcccccacttctgtgccccttgtgcccaggcccagcccagcaccccctaactcctggtacgtttcccccctcctcaacccggtgtctgacagccggacagcgggatctgcacagcaagtgaaattcccgtcggatcgataaagccgaagcgctggcggcgacgggtcgatggtt

SEQ ID NO: 64814 - DNA, 947 bp, Bovine  19866881193748
aattagttacagaaggaaaggataactatgcaagaggtcttacaattgaacaatttaagaagccatttagaaattattccattcttgaggcaagaattctacacattcgtacaggtactaaaaatcactggaagatttttctcaatttcacttttttgatgacataacatgtttactgtttgcttcctttcctccctattcaatcattcagccaatacctataaaagtgtcttctaaatatgagatactgttgggagattaggagtatacatctgagtaagacaccatgtttgccattatataataaccagcaagtgattttacaaagcactttcacagttacctcatttgaactttgcaagatcttgaaacattcttgtcattgttttctaccgaatgaagaaaccaagcccaaagaatttaactaacttgcctttggctattcaatggatctgtgatagggatctgaacccaagtcttcggaccctgaagtctgggttcctcctttactctaggagcttacactgctgcaagaaaactaaagcaaaaataactttaatacatggtgaaatgtgtaataagagaggtaccaaaaaaaaaaaaaaactgtaaaagaagaacaacggagggaaaaattttgactacctaaaggagagatagggagctgtagcaatggtaagaaaacaatcaggaaaggttttatgcagaaaataagtggtctttgagccaagtcttgaagagggggaagatttccataggataaagggtaagagtattctgggttgaagaaataatacaaataaggaggcaggaaaacacacactgcatttagtaaacacataaagcctactttgcctgaattatagagtacttgttaaagaggaagagaactagaagaaaacaggcaggtatgatgcaagagcagagaggactagataccaggctaa

SEQ ID NO: 64815 - DNA, 1180 bp, Bovine  19866881228333
tttttccaaaaagaagacatacaaatggccaacagatttatgaaaggtacccaacgtcactaatcatcagaaaaatgcaaatcaaaactgcagtgagataccacctcacacctgttgggatagctattatcataaaagacaaaaaataacaagtgctgtggaggttgtaaataaaaaggaatccttatgtactgttggtaggaatataaatttatatagctcttaccaaaccagattcatctgttggatgtgcagcaagctaaatgcagaatcttccaagatttgcagcagaggaaaggtttatccacaaggcaactgagccagaagacaaaagaccaaatctcaaacccacctctttcaaggctggggctcagggtatgtatgagagaaagctaaggtgtggaggttatgggaaaaggtgattgaagataagaaaaaggtgagataatcagcagtcctcctgcttctcgggtggctcagaagttaaaacatctgcctgcaatgtgggacacctgggtttgatccctgggtcaagaagataccctggagaaggaaatggcaactcactcagtattcttgcctggagaatcccatggatggaggagcctggtgggctacagtccacagggtagcaaagagttggacatgactgagcaacttcattttcacttttcttttcacagggcaacagatgcacctaggttacaagcttcttcataggatgaaaatgtggtgttagcatgttctgagggtggagttttcggttctttgacatcagaaggtcaccaatcagacactcatgcatgcccagttgaaaggttgatggtctcaacaagtcttaactagcccaaatccaaactagacacagctgactccaagttcctgaaaaacaacttgggcaaataccttattgttaaagcttggagaacatgcaagtttttgttaaaataattaaagagagcttgatcagcaaaggcagattatagttcattctttcttcagcaagttatagtttaatggatctaactactgatgactacccttagtagtcactatggaaatcaggatgaagcgtcctcaaaaaaaaaaaaaaaaaaaaaaaaatgctgatagaagacagacacatttgaaccttataatggtaatgtgaggacctggcacatatagcagaatttttagg

SEQ ID NO: 64816 - DNA, 1161 bp, Bovine  19866881232859
aactcagcaactttctgagagtgggacagggaaacagcctccagtggcctctaggactctcttccttttctggtgccatcacacccaggcaggaaaacccctggcctcacctgctgtgtgtccaatggaagcaggctgtcatcacaggccatggaatggagcagcaggcaggatgccatgggtccacaggctcagccttttgctttcacagaggtgggcactcctggccttcatcattgcccaaggatcgtctcttagcctctcacagtgcccatagactgggatggtccaagaaaagtaaaacctctgccccctgtcccaaagagcaggctcagaggagaaagggcactagggccttctctggacctcagagcattcaagtgaggagagcactgaagcaggagccaggagatctgtgctcttagctttccaccaacttgccaggtggtagtaaacttgtggaaagggaaggtctttggaatcttgccatctcagtttcagctataaagtgaaggcaaaaatacctgccttgtgggatgattaggatcaaaaggagagaatgaatgaatacaaacccagaaccaaatgtactaggtttatcatggaggctccgctgtgccttcacgctctctagccaaaagcaaaacgctgcttctgggtaaggaagaaaaggaggtactagtggaggagagttggtggggggcagtacaaagagggaggaggagtatagcagagacccccccccacacccggccccagagctctctgcagaggaggagatcactgttgctctttctccacccagtgggcatcccggctgtgcccggacctggcaggacaccatgcaaccagcagcaggatctcctccaccccccaaccccagtcccttccccttctttggttcttgtgcctccaccccttgctttcctctctagcgttcctccaacagaagagacagcagagtcccagcacgctgacagcactgactttaagccatcggagacttaggggatttgttcttctctccactcaccccctctccagagcctagtaactcatcaatagcggaaatttgaacaaagtggagaacctgggatgaaaggagaaaggctgcggtgattggggtgggggcaaggggcagggggatggctttaattaggg

SEQ ID NO: 64817 - DNA, 1590 bp, Bovine  19866881287410
agagtggtggcccgtatccgcttctgcccgcaccactcatactcctcaaagcggttgctgttctcatgctcgatgtccgcggcatcgtcctcagccatgcaggagccttccctctgtgaagagcagagcaggatcatgcgggtcccaggccgtccctacctgctccccagggcctgcgaggaaggcacagcccaggcccccagctgcagtgtgccccacaggcccccggctctagggctccttggaagtaaaccaattgagagatcaaagacctgggctttttcccaataattttccactggagccccaggggaggagtgggagagtgaaagcaaaggaagagggcaaagaacagagaagcagcagctgctgagaccacgtggagaccccaacagcccagagattggaggcagtcagcggctagtgtcaggggaagggggggggtaggtggtgatggcccctctaccttagaaaggcaatgctccacatgcctactcatctcctgctccgatcctgccagggggcggctgcacaggggacatacctgcccttcatcttgcttcctccgtttcattttcccaatccgagctgcatggagaaaccaaaaacaaagcacagaacaggcagacggtcactggagctcccaaggtcccagcgggactgatatcctgacctcctcccagacattagccctctggctcacgcccaatcgcgccctcgttacgcggcaccttcagctcctctggggtctgggccctgccacaagtgcctggggaggagactggtgctaggccagccgagtgtccactctttggccacagatggctcaagctcaacccacagctgcctacctgcggtgctcaactgagtccagtgagcaaagatgctccccttggcacttactaggtatctccccagaaggccaagaacgcaggcttttttagagtcaagacacacaactttagagatcacctcttggctagaatccaggtctctccaggggcctgatttggccagctgttcacttatcagttaaaaccattttgttcctgggccagcaggcccgaggtacagccctcagtctcctatatagaatcaccccagggaggatttttctcaggtccgctggtcccattttacagaagaggagatcgaggcccagtcataaaggtacagagggtctagtcagagagtccagaatatcctgagagggtagcccttaccgtgcctacctgaacctgttccatcatttctaatcagtgaagaggggctggcaggcccccgagggcagagggctgcctgccatgctgtcccacagggggctcaattccaaagtgcacactgcaagcccacagcactgctaattaatgctgagagatgcaatcatttctaattagctcactaatccctctctgcagccctcctgtcactgaagcaggaaggggtcaaaacaagggactctgttccctctatctcctcccttgatgcagagctagccccttggagaccagactgattagggcgggggtggagccagccaaggaaggaagggttccccactgcaagaccagaaagaactttctcgtggat

SEQ ID NO: 64818 - DNA, 1198 bp, Bovine  19866881306351
tcgtcctatttgctacagaatccaaagtaggagaagctctcgagtcaacacagatccaactctgatgaatgataccacctatcaaattaagaaaaacatttttcaaaatttctgttagaaacaggtttagcctaaactcacaaggggctctatgaattcaaatgccacactagtttcacagtcatggagaggattaaaagaaagattagctagaaatctcctgaaccattttgtaaatcctttgtcctatcactatcaaccactgaaaagattcgtcagttgcccaaaacaaccctgaaagaggcagatgtctgtggctaacagcttaatggctagaagttcaagtgttgggaagcagtgtccactcattcatctatttatccattcacccaacaaatatttattgcatgccagttacgtgagattcaacagtgaacaaaatagccaggatcaaggagcttaaagttgagtaaatgggattatagtcaggtagaacttgactcaatcccagctccactacttagctaagcaagtgaaagtaaagttgctcagtcgtatccaactctttgcgagcccatggactgtagcctaccaggctcttccgtccatgggattttccaggcaagaatactggagtgggttgccatttccttctccaggagatcttcccaacccagggattgaacctgggtctcccgcattgtaggcagacgctttacaatctgagccactaggaaagatcacttagctaagagacctcaggtaaattaacttctttttgagcctcagatttctcacctgtaaaataggaaaataccacatattccatgggattgtatgctaatgtatcccccccaccccaaaggagaggcttagtaggtcatggcacacttataagaagaacagcttaatgttcttcttataagaagaataacagaaataataatagaaaataaattatttttcttataataagaaaaacagcttaatgattttcattattatcactcagaaagtgatacaagcagttgaaaaatgcctccttctaaatcaataaaatgttttctagtgaaaaagctgataaataggatctgcacaaggaaggtatcattcagagcactccttgaaatcctgatgctttatgaagttatctccactccgatgttcagtaaacatctcaaactcaatctattcaaaa

SEQ ID NO: 64819 - DNA, 1561 bp, Bovine  19866881325988
agatgaggccaaggtgaaggaagtggaggagaccttattttatccctacccccaaggagtcatctggggtctggaccatgactgacccttccctttgttcccagaagtcacctgcatccatcgggtataatagttgatcaccgtggcaacctgggtctgctgcagcatgacctctgcgacccacactggggaagagcagctggcatgaggacactgctggctgccctactcttagcccacagctcctagaccccaaacctgaggtcgtctaggcaaagcagccctgctccaaggagatgtactcaccagcgtatgcccgcctgtctaggtccacctcatcctccacctgccaatgcaatcccatatgggcagttagtgtggaggggggcttgggcaccagcctcctacccaccccctcacatccattgtcctcctaccagccttctccagggtaggtcccgcttctttcggtcataccaatccagcaagctctcctggagggctgtgacctcggccacatctctgaatagatggtatggggagacagaggcctgcaataatgccttctgctgcctggccggccctgctggggtttcagaaaactcagggatcgtccctgcacaggctgtgcaccagaggcctggtttcaggctgtccacttaaggcttcacccaccccaatcccttgcttgagctcagactgggaggctctagggttttgtagcctaggtcaagtttctagcctttatctccccagggaggtacccctggctcctttgtctctggatcataatgaaaatccaagtttctgccaaacatacacctgtggagggccttcccattcacagaacactttcgggctgataaactcgttggatcccatgaaagccaagtgaggaaggaaatgcacagactactgctccatgtcactgatagaaagcatctattcagagcaattatcccaaagtcacagagcaaagtcagaattagatccttaattagtcccttaatgacttgatacataccatgctctcttcccagcctgaatttgccccctttcacggccaattaaaccagcccctgagtctgattaggacccagatccttaccactgggggcagaaggcttggcctggctgctgccaaaggcacatttctcctttccctcctggctggatgcctgcttcctgcgaccacttcgattccccacagctgctcgtggcttcttcatgatcagctagaacagaatgacccagccaaagtatgtcagtcaccatgaggctgaatcttagggtcctgtaaagggtaaagctacctccctccccacaccattcatataaagtgtctagcttttctcaagcactccctggatactcacgggcttacttactcctggggggcttgtggtactgagatatgaccagtagggctgaacttctgcaagtggccttagtgggaccagcattagtatacacctggagacataagtaagaggccagagctgggctgagtcaaggaccaaagcctcctgtgcaggagcatatgtgtacccctgggagctca

SEQ ID NO: 64820 - DNA, 1970 bp, Bovine  19866881334577
cctgtcctgcccttaactcgaatagcctcagagattggggttgaatctggagacaatgtgggtgccagccacctctggaaagataggtttgtggaagatgaactgttgctagagtttcccttcttaagccttactagggtagggatggaagattgttggcatcaggtttacttggcttgattctggatttcttctgtgagcaggttgtacacgcaagacaagaataatcgatgttgtctataatgcatccaacaacgaactggtccgtaccaagaccctggtgaagaactgtattgtgcttatcgacagcacaccgtaccgacagtggtacgagtcccactatgcactgcccctgggccgcaagaagggggccaagctggtatgtgtttggggagcaacttcctgtagggggtgcaggaggaggccagcctgatttcagccttcttgtgatgaaaactctgtccagttctgctactgaagggagagagatgaaagcctttagtgctgaggaaggtggcagggctgtgggatgtgacactcctgaactagggtttgggggtccccctctaagccatctgtatttcctttattcagactcctgaggaggaagagattttaaacaagaaacgatcaaagaaaattcagaagaaatacgatgagaggaaaaagaacgcgaaaatcagcagtcttctagaggagcagttccagcagggcaagcttcttggtaagatgacttctgcatttggggaggaggcgtctcaagatatggtgtgctctctggaggctagagagttcaccagaaggatttggtaacagtgaacaagcacaaatcagaatatttggtcatctggttagtttgaagcggaaatggaagatagtgggcaggagcccataggcctgaacttggtctaggcctctgaatttcagtagtatcttgagaactcgtctgtgtccaggctgaggggattgtctcagtgatgaaaactttgtccagttctgctactgattttcaaagtgatgataaagtatatctgaggagacattgggctttgtgtctgcccccaggatacctggaccaacttgggcgcttaaggggatacatagatatgggtagggccacagtgtcattttcctgaggaccacactctaatcttgcagcatgcatcgcttcaagaccaggccagtgtggccgagcagacggctatgtgctagagggaaaagagctcgagttctatctgaggaagatcaaggcccggaaaggcaaataaaccctcttctctcctgtcttagctcatctaataaaggcgtttactgttctatgccatgttcatgttctgagagtacttcattgtttggcacactatagaatgccccagttccccctgcctgaaggccaggcctgttacggggctgtgactctagccggaggaacagttctcgctcctgaggctgagtttcagtggcaacagggatgtgttgtgcaggctgagtagagattgagggaggtaacccagcttggggcccctgcagtattgggctgttgcctggaccatcattggaaccaaagccatgttgcctccctaaagttcttttagagaccctgtatgcagactttggtttggggtttttttcaggctcctggtctagaaaccttgaaattgtgttctacacttaagcattgttgagcaagttatacatattaattatctcttgagctctaatcctttcccctctccttactcaaaagttagtttgtttaaattgttgaattggtttcttcagctttcccttttcatagttcctcagttatttgattgtagcaaatagtggtcttttaggttaaagacaggttcaatcttagcttatccttgggtcataactcccacatcaaatgtcaccaaattttgtgtggtgctaatggtaaagaacctgcctgccagtgcaggagacataaagagacgcaggttggt

SEQ ID NO: 64821 - DNA, 664 bp, Bovine  19866881379053
gactctgatgacatacatggttgagggtggcggctcaagcaccatgtctcaggccaagcgctggctttaccagagaccacaagccagtcaccagctgcttcgcatcctcactgatgctcttgtcccttatctggtgggacaagtggctgctggtgcccaggtaagacctgagggagagacatagcctggggcttaatctttaaggaccagaaacaatacagttccttatacctgagaagctaggtatcttaatgccaggcataaaagaggcttgacctgcagtgatctggctggagcagccaagcccagatactggcaggggggcttagtgctctgttcaaagaccaaagctagcactgggatctggagaaggcaaaactttttgactggaactaggtttataggcttaggcaatctcagggatgaagtcacttggggaaaattgaggcatattctacatgtgcctcctctttgtatgttatgtatttcatttattttcatcaccctgtaattgtaggcattgcaactctttgagtcccatgcagggcatcttggcccacaactcttcagtaagtttgcactgccctacatccgtgatgtgtccaagcgagtgaaggccgggctgcaggaggcaggcctggcaccagtgcccatggtaaggatg

SEQ ID NO: 64822 - DNA, 1047 bp, Bovine  19866881385818
aaggtgaaaggactgtaatcaataaatggtctgcaggctgtcatttcatacaaattagagtcagagaaatatatgaatattcacttgaataaaaatcattcattataggagtggcccttcaagtaaaaggatccctgtcaaggcccaatgtggctgtcattctttgttccattttgtaactaaaaaacaaaaacaaaaataactgtgtagagatgaaagagaaaaaaataataatttttcatatgcacccacctctgaaacagtcaagagcaggagcaaatttcttcatgacacagccaaataatatgtcaaaattagatattcaaagaatgttaataaatgacaagagacacttcagtcagtcacatgattccgatccctgcagatgcacattatgattcagatttgaatagcaaacagagtaggccacagggcagggtgggaggacttgaagaaagacaatgcaaaaggtcatcaaaatgaaaactgtcttcttgcctcaaaatttgaagagaagttttactgaaaaaaaaaaaaaaaaagctttaaaccaattgaggctgaaataattacaacattttatgatctaacctcttaatgatgaatagaattcttctccctgcttaaggatcaaattggttgggctctacacttgtctggcaccatgctgtgggctatttcctttaatatataaccaatcaaagacgtattcaggcttttgtgagacccaaagctttgctaactgcatatcctagagcatcatgaggtttttctaaaaggaagcagacaaagcgatatacagtgatagcctcccttggataggtgatattcagtagaccctttctcaaaggtagataaggaaaccttttataatacaccaaatagacaattttctttataatatctgtagtacttgtcttataatatttatactaatttttttcctcccttcaatttatatcaacatacttcaaggtcacagatgcttaggggagtgacaaaagaaaacaaactcttcaaaatatgtaactgttaaaatacataaca

SEQ ID NO: 64823 - DNA, 1222 bp, Bovine  19866881480974
tggttgaccgttttcccagcaccacttgttaaagagattgtctttaatccattgtatattcttgcctcctttgtcaaagataaagtgtccataagtgcgtggatttatctctgagctttctattcatgggtaattattaaagattgaaggcaggaggagaagggggcgacagaagatgagatagttggatggtaccgccggacttgatggacatgtttgagcaagctccaaaaggtggtgatgaacaaggaagcctggcatgttgcagtccatggggttgcaaagactcagacatgactgagcgagtgaactgaactgaattattaaagcaccaaactactcttggagactggattgagattggaccacatagaaaaatgtaaattgtgacaattcacagtcgtaccaaatagctgaattcattagttccttattggcaggggtgggtattgggtgggtgattttgggtcatagtcattgtttgtggaagtgctgagtgggtaaaagcatggtagttaccttaccctgacagttttttcccaggggagtaagtgtgtttttctttctccttgctgtaggaaattgtttgccagattgtgttacttataacaatctatcatggaacagctgccaggaaaagaaaagaggctattcccagtagctcttccctcctcctaccctaccattaccaccacacacacatacatccggttttatttttttcttctagttttacttagtggttttggcttgattgaaatgttcttataatgacagatttctggactttgccatggctttgtaattggttttctaagctctatttgtttgctttagccaagactaatcggcagcagttcaagtttgaattctggggtatcttgaacactaaagtgctatcttctaccttcccttgaagaccttgtatgtttccacttggtcaaaaatgcacgcatttactgtcctttaagaactgtgcttttcacccttgacgttgcccttgttccgttacaggagcaggcttcggtaaagcttactgaggactgttaggatagtgaatagggaggtctgtggagatgccagttggtctctacagatgatgcatactctgatgttagaaaagaacacaaggcaactgagggttgatgtctcccaggaactttcaagttaattgcatttcagatatacagttgcttgacagtccaaacagtctatgtttatt

SEQ ID NO: 64824 - DNA, 694 bp, Bovine  19866881547737
atgaaagcccacaacgctcctgcagctgtcccaggccaaaggttacagcaacctgagagcagaaggaaggaggtcaggttggaatggagaggccgggcagcccggccctccacaccggaacctcctgcaagcctgtccagcaacacccacctgcagggcctcgcaaaccagctccacgtccagtgccttcaccacaaactccaggcacagctgggaacagaaacgaaggtgggctgtgcccagatgtccctgttccaaggccccagccccaggccagaaacagtgaacagccttggagcagtgagccacccaggctactagcagccccaggcctacgcagacctcccaggccaagggaggcggggaatcacaaggcctgagactaggaatagcaaagccaagcccagcagcccaccttttagtacattcctcactaatcagactagataagagccatgtgaaaattccactctccttttctttcaagacacttaactttttccacacttttctctgaattcaaagatactattttaaccagaaacttgaattcatctgtgatatctccctctcaccccgacttccagaaaagccctgggtaatgccagttcacagggtcaaaccagccaatcctaaagggaatcaaccctgaatattcactggaaggactgatgtcaaagccaaaactccaata

SEQ ID NO: 64825 - DNA, 993 bp, Bovine  19866881581867
cgcataggcatgcatcaatgcctgtttatatagagatacccatacttctttctgtattggtgcacattcctctccacgttagcgggtgtgtgaggcagggtgtgaaccgcgcccataagagacaggggaaaggagacggctgcccatgaacccacctctcgaagttcctccagcccatactccacagccgctgtcaacacctcaagcacctgcagagtgagtggttggcatggtagaagagagtcttcctgcccctcagccacccagaacttgcccacccagacccttgcccagtgggctcacagagtggcgttgcagcttggcactgttggtatacagaaactccagcactgccaggaaggcctcagctggcacggtactcagcaccacagggctaggcaccccagggcctggctctgagctcagaagtcgctggaagaagttgcatctacacgccagcaagcaccggtgggcaaacacctcctgccgttcttgaccaaccacaaagcgaacatcactgtgggagagaagggcagagtgccagaaagaagaggctagagtctctgtgtaactctagactttgcctttgccctctctgggcctccgtttccttatctgccatataagaggcagtccctctagcaaaaggtctgggtcacacaggccgggttctaaacacagctccagctaggcaagagaagcctagggaagagatttctgacctactgcctctcaggtttctcatccctgaaatgagatgctcatcccaaaccctagggtggctaacattaggtggctatgtttgatcactgagggggcaccagggctgaaacaagatcaatcccaatgtccctctcctccccagcctgtgactctggtgaagggaaactctttttggcttctccagactgcaaactcagccttttcagcctcctccagacaggaggggggaggaggagggtgtggagggcacgactgcaaacagacacgtca

SEQ ID NO: 64826 - DNA, 1430 bp, Bovine  19866881591457
aaaccaggttgtattaagcatttttccagataaagatacttaaaggctcaatcaggcagtcacccagggtagctaaaaagtggcaaaggcaggagaggaaaccatgccttactccatagcttcaaaggctctcttgtcccaagagtgcccccagctgatcagtatcaacaaagacggatcctgtgaatgtgctaggggagcacttggaaccccagctcctgcctgttgagggcctgaagcagggagttactccagaatagagcagccctagaaagagccaaatcaacaggaaagccaccatctcacaaggactgagcatggagtttgggaagccttggcctgcagcctggcccatctcctctgtttccgctgctctcactacaggtgtgaccatgttttggtgcccacttgattttgtggacaaagatctagactcttgcaccttgactgccctaacccttggcatctcaggctcaatccaccttgacactctagagccagggctggggtggagaagggatgccaggtatcagaaaggcattgagcaagtgaccctgagagttcgagaaggctgtatggagccatgctccggtacaaaggtgcatcccctaacctgcctagagccggagggaatgcctctctggtaagaaggagacgatgagagacactgataaattgaataaagaggtgaatctcacaggactgtcaaggaaactaggacactggatgcgttgctcgcccaagccacccatgccagaaaactccttgtggtcccaggaaagcaccctgatggactgggcatcacctggaaattctcaaataagcaaggcaggtttgcttattttcttgccatccatcttctaagtcctgaactaagcttactaaagcatgatagggaaaagtgtgttccctacctggaagcttccactatcaggaaaagtcaaagtattgccaaggaggcagcatggcatggtccaagcagcacaggctttggaggtaggtgtgtgtttatcgctcagtctgtccgactctttgcaaccccatgcactataatataatccatcaggttcctctgtccatggaattctccaggcaagaatactagagtgggttaaccggttcaaaccatggctcggctatatcccagctgtgtggttttcaaaaaaccacttcacctgtcccagcctcagtttcctcatctacaaaacgagtgttaacactccctctcagttatgataaagacgcttaacatggggccggcctatgataaatgctctccttttcccaatctggggttcagcctggcagcagaaaccaagtggcaggaactggggatcttgaacatcgatggccttaccagctggtccagagacccccaagccccttactgccaacccccagatataccacaccctagtcagcacaaaaaa

SEQ ID NO: 64827 - DNA, 888 bp, Bovine  19866881721333
cctctccatcttcagaggtgattaataaatatagacttatccataaatcatttctataggagccaaatggttcttcttcatgccgggaaaagaaaatcatagaaacctcaaaacccttgtactaagccaaaggcccttcacaacaagagagaagaggtattaaaagtcagaaggtcactaggtcttgtctctaaataaaatttctcagagggcttttttgtcctcctaaatcaaaagacatatttcaaaaagcaagaagcctccagcacatgggctgccagcctggctccctgtcctcacaaggccttggagacaaggcagccgctctctcctgttactgctggttccatctgcagaatggacagaggcctctcccagtcatactcctcactctcagctcctgattcagagagagagagggagagatgcagggagaagacagatgcagagggagagagagaaacactctccttccaaacctcatgcccagggtgtcctggccttcacctccaccttagggccaaacgtactacaatatgtcactttctcctcatagatgttcttccttctgctccctactcataccctcttcacacatcccttctgctacccaccagctccccacagactccatatgcccccatctcgtccccacagttagctgccattccctccatcctctttccacagaccattttccctatggctttcctgcacaaccctctgccttcaccagctgcccatacttaccctcattctctacccacagacccccttttcctcatcccagactcaattctgcctctggctccactctgcaggcctgccctcatgctctccccacaaaatgtaaattatctaggttcaccagagtctcctgcccaagtt

SEQ ID NO: 64828 - DNA, 1296 bp, Bovine  19866881814865
cgcttcagttgtgtcaactctttgcgacccccacagaccttagcccaccaggctcttctgtccatggattctccagacaagaatactggagtaggttgctatgcccttctccaggggatcttccccaatccacatctcttatgtctcctgcaatggcaggtgggttctttaccactagtgccatctgagaagccttcaagtaggcattattaaatgtttgttttgcatgatatttatcagaaaattcctctaaaagtacatctctcttttttatcttaaattacagtaatgacagaaatgggagggcttctaataaaagagggaacttaaaacctgcctctattatttaaatgtacttaatcattcatttattaattcagtgatttattatttaccttactggatactagacttacaaacttgagaaagatctggtccctgtcatcaaagttatagtacaataagataagcaatggtagaaatacagggggcccaagaggcacaaaggatgggatggggtatcaggaaatgctttccaaaataagcgacttgagttgggtttagaaggatgaataagaattagcaaagctatgaaggggaagaagagtattctgcatagtacttaagcatatatgaaggcagagagagtttaacatttaaatattctgaaatacatcttgggttccctttctctttgactcagttcattactgctgcctgcttgagtcacgcaggtcccggtggacctcctggagtggaggctgaaccgtggtgaactcaggccttggcagatgtgtggatgtgcacttgtgtggtggctgtggaacctcgagctgagaacagggggctcctttggagcatgagcctcccacagggcgctcttgggatgcctgtcccggaattacccagggcagtaacaaagctttcttttcttctttacaccaagccagcaggatgggatgtctgctagcctttgtgtttggagccaaccaacaaacatacagtgaccagtacaatggcattgttgggcttcagtgaaaagtaggtcgtggcccaggccctcctctgcagagggcccatccaaagaacagaggttggacaagcctctgatttggctgtttggtattgatgctggtttctgatgggctttctgacttacttttggtgtgtaacattgtaggatttcttcccattgtttccaaaaacctctatttggaatctctgagttgcctttgactcttttcccttagttctcatatctactactcagttgctaaatcatttagattctacttc

SEQ ID NO: 64829 - DNA, 757 bp, Bovine  19866880510067
gagtccacctacaatgccagagccctcaacttcattctcaacgtgagtataaaaagccgagctatgcacactgcacagtaaacagcccacagaagtcacatcagtgcccactgtgcaactctgaacaattttaaatattcctgtctggttgcattttacacaacactaccacaatacagggcttcccaggtggcgtggtggtacagaatccacttgccaatgcgggagaggcagaagacacctctggttctatccctggggtggaaagaccccctggaggaagaaatggcaacccactcaaacattcttgcctggaaaatcccatggacagaggaggctggcaggctacagtccatggggttgcaaagagtcagacctgactgagtgacagcacacacgcacatacaaaccgcaatacaaagaacacatttagacacttctgagatgagggaaatggatgtgatggtgaagaattagaaacaggagcactagctgcctggaaacactaccgttagagagaagaaaaatctaaaagaaaaaaatcaattaataactcagtcagtcattcttccatgcagatctttgtagagaaaatgaggctattttgtcaaaataataatcatgttttctaagggctgtcctgctaaaaatacagcttctctggagaagcagctacatgctctctttaaatagctccatttggcttgcatctctgcttgtccttatcttaacgaataagaactgtctaatatccctc

SEQ ID NO: 64830 - DNA, 1513 bp, Bovine  19866880521880
taactcagtttgatatcattaattcacacaagagttttgcatttgttcctttcaggtaaattcagtcttactctataatcaggaactctaagtgaatgcaacttaacccaatgtttctcatttaagaatcaccagtaaaatttattgaaatactaatccttgggccccatcctcagagtttcagattcagtcaggttcagttgggacttgaaaatttaatttgctgacatattctgaagattcctggtgcttccagtcctgatgtcactctttgagaatcactatactaccatacgcaccacttttaaaaaattaattaattaatcagtttagctgtgttgtgtcttggttgcagcacatgggatctggttcctagatgaaggagtgaaccccatgccccctgaattgggagtgtggagtcttaaccactgaccaccagggaagtcctgtgcattactttttaaaactttattttgttttgaatctccccaaattaatttcttttatggagctatacttttatttgaatatgatacttaggactacattattcaaagattatgacattttctttctatgcttttctttttaatatctgtttcttacttgaactctctccccttttataacatttttgagataatattactatacaatgaatcaaagatgactatagatcaaagtttgtattatgctcttagttaattagatgtttatttctcacctttttccaaaatttgaggcagatagatcaaagcaaagctaattaaaccacaaagttattgaaatcaaggcctgatttcctttgccccttgttgtggactgatcttcctgcttctaattaccttcccaccactgaagtgaccacactggccaaggcaagaatcatgatgattatggtcagactggtttgcgactttagcttatttttctaacatattccatatacactgtctacagagtgcctgattttatactttacactcagcaagaaagtcaccttaacatctccatctatctactgcctgccagagagcagctgcaatgtatttaccatcaactgagaaagaaatctatatttatcgggatgtggaagatgctgaatttaccgacaattgacaaattagtctggaatgagaatgcatatagaaatagcctgcagtatgccattatgttgtgacataaatatatggtctcttccctcaacttatgccagaagcaaatgaacaatgtttcagcaacatgagtaatttctcatctacattagtatgcttttatttttttttttctctctctttgagttgttaatagctataaggggatatcctaataaccacagcgaaattcacttagaaagccatattagcaattagtaaaatctccaaatgctgtcgaattattaatttaataaaaaaatttaatttaaatttattctctctcccacttgctctatatttatggtatgtgcatatgcacacatatatgtgtacacacatagctctataatagcaat

SEQ ID NO: 64831 - DNA, 1216 bp, Bovine  19866880532286
tccagatataagaaaaacttctcctttatctaacttagagcatatttgttctcttttaacaacttagaatagtttgataaattttatctttgtaagcagaatagaaatgtttatcatttttctccctgactgatccctctggaactcagaaaactcacagtgcttattcttattttcatggcaatatagttgctttcataagttcaataagaatctactcttcttgtaacaggacacaaatagaaacattggttttattgccaaggctttagctggaatttcacatttgagaatgaacctagattcagatatgaccagacagctttgaggaactaagattgactttgctgctgctaagtcgctcagtcatgtccgactctgtgcgaccccatagacggcagcccaccaggctccccatccctgggattctcaaggcaagaacactggagtgggttgccatttccttctccaatgcatgaaagtgaaaagtgaaagtgaagttgctcagttgtatccgactcttagggaccccatggactgcagcctaccaggctcctctgtccatgggattttccaggcaagagtactggagcagggtgccattgccttctcccaccttgtttacaggtttcccagaaaccttaccaggtgcgtaaggaagatcggttcccaggcaggcccaggaatctcaggatattctggggacctcaagaagaaaggaattcactcaaatctatcaatattgcaggtgatatctgatggcaaatgtttgacttggcttcttagccttgagaggctattgaaagtttgctctgggacttccttggtggtccattggttgggattctgcctgccaatgcaggggacatgggtttgatccctggtctgggaagattccacatgctgaggggcagctgagcccatgtgccacaactactgagcctatgtgcaaaagctactgaagcccttgtaccgagagcctgtaccccacaagaggaaccaccacaatgggaagcccatgcaccagaactagagggtagccctgcttgccaccactagagaaagcctgtgcacacgcagtgaaagagacccagggcaaggaccccccccccccccgcccccagtaattaactgactgattttttaaaacgttcaatccgaagattccttatgaaaagtgccagcaaaacagactttttaaaacctgtatagtaat

SEQ ID NO: 64832 - DNA, 1422 bp, Bovine  19866880534483
tcctgcgtctactgaatttttcttactactgagccaccagggaaacctcccaggcattgggctctgggcaaaatgttcctcatttcaataagatgaaatagaaagaacacagggaattttgccatatttcctatgttctgagtgcaaaatttcactctgacttaactggggaaaactcattctttcagccagagggcttctaaaaacccagagatagaatcatatagaatgtcagaaggagatactctctccgggagagatacacatggtacagttaggtataaatggtgagtttctattttgggggtttgaaaacaaaattcagtatatcttcagcatgatctacagtgttttttagaaattccatgtgttgaagaaccaacatgggtcactttagaaaatgcccttgacaatggggtattttgaggtatccaaatacttaacaatatttcctgattcctactctctcttccctggcaggaggaaaagagcaaaagtaccatctctgcaggggtggatccttgaaggatagcagcagagtcagaacgtccttcatttaaaagccacacttttatcatcaacagaagggtctgtgtcatggggggtgggtagcatatgggaaacaaatactataaactagatttaaaaactgttaaaaaaaaaaaaaaaaagccccagatcacagccttgactgtggaataaatagcattgcgaaggcaggtcgaaggtaacttagaaaatgttgcagagttctttggttaaacattggaggggtggtggagatctcaaagcaacatcacaggatgtgtgtggaagtttccagtagtttcctctggcttgactttgccttctactgggtgggcagaggaaaataggtgtctctcctgggcccaaacctagagacagaccacagacctgatgcgttgattcaagagctaatactagtgcagctttctatttatagaaaataattctcttatcttgaatcaacaaagaactgggctcatgctaatctccatcataattgtgacactcagttcttcttgattctacctgactttccttgtacttctgcttgtcgtagttactttgttgtgtttccttctgagttaattgcctaactctaatagatggcattgtaatagaccttgtctcatcagcattcagaactgttctcaagcttgaaaagaaacagagtaacgaaaagatttcttaattatactctgcattctcactcattaattgacctttctttcaagtaaccaaccataaatcaactaatgctgtatacagtgcaaataaattaacaaatgtccacataacattgtgtgtctatcaggagaaatttattcactagtgatcgggctctgtttacaaccagtatttgagggtttgaactcattaatattacaaaaggaaagt

SEQ ID NO: 64833 - DNA, 1265 bp, Bovine  19866880602050
aaatttggactaattgtaagaaatcttcgctagaggctcactgaagtattaaatattggcaattcaacattttctcatgactctcctcttattcatatgcctttgtgcttgtatgagcctcatattagtccatggctaatgtttttatggtagtgagcactgaggggagtagggacaggccatcttcatttcatcagaagaatcattctcatgaagaggggaggttttaccactttttacaaaactgaagaaagaaaggttggactcacctctccaccaagtgtcatgggatgttgtctgctcatatcctaccttgcaagatagaaacacagtcaaggagaaagattccctaagtgtctcaaatcatactaaagaaatcattgaaaattgtgtctttgtctcacgctttccatatgacgtttacgtttttatcattctaattaaattacaccaaagtgtgaaataaatgtgtttgctctttttgtcatggtttatttgcctaagaataatgaaaatcatgcatgctctttctgtaaaagctttacggaatagtctgaagtgttgaaagaagcagactgatacaggtgggctcttgatgtcacttaactcttacaagtttatggctaatattttcatggtagtgatagtactggtggaagggaggaggccattttcattttatctatttattaactttagcacttgagcaaacaactgtaacaaattgccatgggagaaggggaaatgaaatgagaaaacagggatgatttttagattctatcttgtttgtcatactaaaaaccacaaacaaaaaagtagtttaaggagtcattgagggagaataagtatggaattccatcgtggaaattttataatcacttccctaaaaataactacattttaattgccaaaggaaaaaaatctacatacataagaaccatcatgaaaaacgaaccattgtgatgaaggaaacaaagaaagattaaattcaaatcagagtatttgcttaatagcttaagcagttgctaatgtttatatattacaatgtgaattatcatgcttggataatgaatttgttgctttttttgttgctttttgaaaagtcatgaacatttcaactcacaacttctcatactaaacagatatgcaaatattgttaagatgattgtctattttacaataaggttaattttgataaaaggcacattaactctataatcataatagggctgatcaagactgggttgatcaagaaagcaacaaag

SEQ ID NO: 64834 - DNA, 1369 bp, Bovine  19866880635544
gagccttctaaaagcagtgcttaatgcctcatgaaggtgttgagaaatgctgccttcaaaggtgggtttgacatggttcattattcttattcgaattgtagtcagttgttcataaatatccttcctgaactagcatctttcatgttgttgcacagttgctaggttatgtctgactctttgtgaccccatgggctgcagcatgccaggcttccttgacttttactatagtccagagtttgctcaaactcatgttcattgagtcaaaaccataaagcctaagaaaaactgatgcccagaaaacaatggagccaggaaaaatagaataattgactatgacttagatataaggtcagaactgtttttctcatgagaagaggagaaaactgtgagtatagtaaaacaggctcagtttttctcttggtatttccccatagtttgatacaaactcttcattttagcaatccttttcaatctaccagtgggaaaacagataagagtcaaaaataatgcaaaaatatatcacagaaaatgtttgtattgacatttttaaatatgcaaaaataaatatactgtgttaaataaaatatatcattaaaattaattcacctttttttcccaatctattaaggtggttaccaaaaatgttaaattatttatatacagctgactttgtatttttactgaactccattgctagaatagaactatttaacttttcaatgagttgagaaagatttatctgtaagattacattagtttggagtacataagtttagagtgagtttgattaataatttgagtgactaaaatacattatgcaattaagacagactatacccaacttcagacagtaacctaattcaacacttgatgatttgcatgcagatatagaaaatcaatcttgatcctccacaaagcttaggatgtcttgctgaatggaagaaaagtaagacactttcaatagtttctttgttgggcattcagatttaatctactgctcaagtttatacatggaatcaatttctttgtgagaagttctacttcttgcatgcagtagaatcatacaatcacagataatagcaaaattcaagtgttttatcttcagttgctagtcagagagttctgagacaccactccccagcccatccacataagaactgtatgatcatgacccaatgtgttcttcctgattggaaatactttcgtctcagccaatactcctgctagaaattctaagaatattgctggagcgatgtgttcaacttggagattctgtgcattttggaggcaggaaacaggtagattaggaagaaattgggatgctgttgtatggacagtagcaggaatgtctgggcagtattattctgaa

SEQ ID NO: 64835 - DNA, 1877 bp, Bovine  19866880651612
ggagggattggggtaggaggagaaggggacgacagaggatgacatggctggatggcatcaccgacttgatgtacatgagtttgggtgaattccgggagttggtgatggacagggaggcctggcttgctgcacaattcatggggttgcaaggagtcagacacgacttagcgactgaactgaactgaactgaactgaaggtaatcttagatattattttaagttttgtactgacaaactgagcttttcctttaagtctgttgaatcacaattgaacaggggagatagaatgagatcctaaaatatgaatctagtgcaagtgcctcaacccccccaatcttccgtatggttctgaagtgttcttccttcatgtataagcattgcatcctcacttgtgtagcaggagatcccacagggttcacccctctttcatatctttaaacagtatccactgtgttcgatttcaagggttggtgacatttcaaaaataagtctagcatttgatatagcctggcaaagagcataaaataaaataaaaaaataccatctaccatttattatcactataggtttcataagagaaaggacattttcattttaaaaagcagaagaaaacagaataaaaggcagtccttcacaggaataaatggaactttatgcgaaacacacgttcttttgtgtagcttttttctatctggcagcaggtgcgtgaaaattttgacatttgatgtgcagacgaataaatctgtctgtcagtggacagatggatgaacccagagactggctttgtggagccacagacccagaagattcctgagcccaggctggagtgaggagtgtggttaggattaccagagaccatgttggctgtgctgtactgctcaggagtcctggttagtcagctcaggccagccacactgtggtgaaaggcttcaagtggacaccatgttcgtggtttgcttttttacaaaccccagggccctgtgtggtccaagtcagcaatctctagtagcccccaaagaccagaaaattgcccatttccaccattatgatatttatgtatgcagtttcccctccttcctcttcctgaggtgtaggccagagtggccgctgatgctgtttttgtaacactttgtcctttgggatctgagaggtttaatcaaacaaaaaccaactgtgaaggaaaactgaagccaggaagggatcacgtttatggttttccgcagtctctcccctgagttttcaccttgttttcactcctagcttccctgacttctcaagttctgagacaaaacactctcaaaaataccagcataggaaactttgcacacttctgaggactccaggtcactctcatccacacacacaaggaatcaggcctcccagagacacgtttgcaaaggcacacagcaagttagaatgctccattgtctttattgagaaagagaattctttccccctttagttagctgaaacagaactatagcttttcaaaaggaaatttgaaaataagtcaccaaaaaaaaaaaaaaatcccaataaatactaaaaggaaaaaaaaaagttttcagaaagcacatatttcattaacattcctaaaccttgaaaggcagaagagcttgcttaaaacaatatggactttggaaacaggcccaaatcctaaaaagcagagacattactttgctgacaaaggcccatatagtcaatgctatgatttttaaaatagtcatgtacagatgtgagagttggaccataaagaaggcctcacaccaaagaatggatgcttttgaactgtggtgttggagaagactcttgagagtcccttggactgcaaggagatcaaaccaatcagtcctgggaaatcagtccgaatacttatt

SEQ ID NO: 64836 - DNA, 1657 bp, Bovine  19866880687028
attctcattaaatgatgcatcttgcaataatgtttgagataattactcccacagtccttaacaagtatttattggaatgtgttaggcgttttagagtacaaataaagacttgttcccctgactgaaaggagcttgcaaggtttatttcgctaaagtgtatctgtctttagtctgaatccaaatacaaaaaggtaaattctcactgggaatgatgtgtgatttggcatctggggtaggtaacacatggacaaacattggagggaggtatgtttcagcagctagtaatatgtatagaggagggaaaaatttcctttttcctgtatgcaatttgggctccgtggctgggatcttataaattagactattgaaagacagattaataagaaaaactagcaggctttccttgtagctcagcttcccttgtagctcagcttcccttgtagctacctccaatgcaggagacctgggttcaattcctgggttgggaggatcccttggagaaggaaatggcaacctactccagtattcttgcctggaaaattccatggacagaggagcctggcagactatagtccatgggatcacaagagttggacatgccttaataactaaaccaccatagcagaattttattaatacatgtgttgcacatacctcatgggaacacatgatgatgagtaacccaaaggggaggttagaacttgggcttaaatatcatcttagactaaagaaaggaaaaggggtttgggatttttagatggtggaggcaagttgtgggaagatgactgacactatgcagggccctgtggggctcttggaccttcccccacttccttggttataggaaacagccctcattcagtctccataccttccttgagttccaagagggcagattcaagcagttgttaattaggtaagggaaagaatggaaggccaaggggaaacagtcaagagcagccttggggcaaggtcctgtttccccatcaaaagatacacacaacaatatttttgagccattgagcagatactgaaacctcctccagatggaagaagttaatgattaacaatggtatattgcccacaggggctcccctgatggttcagtgagtaaagaatctgactgcaatgcaggagaggtaggagacgaaggtacaacccctgggtggggaaaatccactggaggaggccatgacaacccactccagtattccttcctggagaatccctggcaggctatagtccatggggttgcaaagagtcagacacaactgaagctactgagtgcacgcacacacacacacacccttttgtctggcaatgcaataaagttattcttttctacttcacccgaaactgtcttctaaattggatttgacatcatgattcggaatggtatggtcaaggaggtttattctagtaaggtttgttttgcagatttaagttggtgccttctccattaataagagttacttagaatttccctcctcttagctcaggagagggtgagagacatctttacaaatgtaaattttctctactaaaggaaaatgtaggcactgtttttagagcttttttttcattcacttgttcataatggcctttagctcaaaaaagccatatgccaaagaggcatgttttgggatagcttattctg

SEQ ID NO: 64837 - DNA, 1740 bp, Bovine  19866880699013
tacccaaacgtgccttcctcttccccagttttttccctttacttatgcagaggccaacatgttaaaggacaccttttcttccgttttctctaacgtcaacatgtttaaatcctgctacacattaaaactatctgacgagatatctctttgtcaatcctttactgattacactgattatagtgactttgagtttgttattcctcttctctagcactctgtgacatttctagttttctgctttgccatgtagtattatgagtgttcctcttatctccactactgtttcagaaacctcttggatcaggaggtgtttctgctcactttttggtttttgccccacccccagcacctaccataatgcctgacacagacttggtcctctataaatatttgctgaattgattttaagtttgaattaagcagcacaggatgtcttgggttgaaaaatcacattgcaaatcgcatgcttgtattgctcaatattgctgcaccaatggagcaaggaatatgctgcaaattcttcatataaatggtaggagtaagggaagaaaaggtgctttcataaaaggttgtctacagaggaaataaaagaagcaggcaaatgctatagaatttttttcctaaccaatggtggtgattcatttgtctggttcgcatttctgttagattccagtgttagattcaaaataaggctaatttgcattggcatagtgacttaactcactagtgtattattactatgtaagcaggtgtacatgcgactacaaataaatgcttgctgatggaatcccagcagggcttctgatgagttttcattttgttgaaccttacccaggaaattactgtgtaaaaagcttagctattagttctttgcctgaaatatcgtttagctacacctggccaaattcatggcaattatactaactatacaaagaggacattccaaatttctcatcagcctttctcaaattgattactgaaataatagaaatatacaaatgcacaaactgcaaaaggtacacattaagacaaacttagcatttaaaagtcaagataacttataaaagaagataatttaagtcaaactgttcataggatagaacccatactataagttatcaacactaagctacaagctactgcttactaatgataggtatgatgtaaactttatgtgccttaattgcagccctatatatgcttatgtggagagattacaatttttttctgtattatgtgatacattaaaaagctgacgataaaaattgggctcttagtgtcacagcacataaccacatatatcaaatttttaccacagccaatcatgtgaaatgagcaaagctgccatatattcatagctgtgttataacaaattttatataacaaattttgttatggttattccaatgtagatttgggtttaaaaatattttagtcaatagtcactgtgtatctcctctgtatgggactgtctgggaaaggtttaattataaagaatataagatggtctctgatttcaaagttttcactcattttgaaatgggaaatgaagtaatattcacattaaaagataatgtaaaaatataagacaatgtatgctacatacttgctccaggtgatggtagagtgagagagccaggagaggaagacgttggggaagcttccataaaatcgagtgaccacatgccctgatttgaatggaagaattataatttactgcccatattcctggtgtaacaa

SEQ ID NO: 64838 - DNA, 1133 bp, Bovine  19866880750783
taattgcttgaacatcttacctccccctttgtcagaagtcatgagagcaatatagacatgctatgacaaagtcagccgccactatcttggctataattccatgtccagatgtcatcctgtgcagttgctgtgtgattctaattgactccttggggattcccagtttgtgccgctcagggcccaattcagcctcggagttgtgagtgagtaagtgatgacagaggttgactcagtgtgtttgtgtttgtggaagtgttgagagtagaaggttatacaaaggccaacagtcattacttccagggcccagtggaactcacaccttgcttatcagcttttaccttaacataattatgtatatattttgaaatatgaaaacacctgaaatttattaactgaaaggtaataagtctttcaaaaacaaataaaagctagtatgtataaacatgcatatttatacatacattcatgtatatatgcatatatttgaaactatgcaaagtttttaaaataaaggtaggcattttatctgagaatagtgacatctttcctggagttccacatatttgaaatttttattgctgtgccaagtaagtggtattgatgttatatacgcttagtttttctttttgttcttaaatacagcttaaaatatatagtctctgttaagaaattagtgtaccttcaaattcttaatcttactctaaattcccagctaaaggaaacatatcctaaatgtcagtatgagaatgataaaaagtgtctagggtgaagcatagggaagcccggtgtgttgcagtccttgggatcagaaagagtccgacataacttagcgactgatcaacaacaacatcaacggctctattattcctacacaagttgccatcatcattattcgaatgtgatccaactcttaaatttccacacggtttgatgcataaattttgacttctgaaaaaaattttatttaaaaatagctcaagagttttataatagaaaaagaaaatataacttttcatcaaatagtgttgtgaattttatatatcagtaattcaagagaatggctcttaaaatataacttaacttttcataactttttatctgaataatcgatattattcggagagaaagactaa

SEQ ID NO: 64839 - DNA, 1969 bp, Bovine  19866880873075
atttctcttcactttccaccattagggtggtgttatctgcatatctgaggttattgttatttctcctggaagtcttgattgcatcttgtgcttcatcaagcccaacacttcacataagttaaataagtagggtgacaatatacaaccttgatgtacttcattcctaattttgaaccagtccattgttccatgtccgcttctacctgttgcttcttgacctgcatgtacatttctcaggagacaggtaaggttgtctggcattcccatctctttaagaattttccagtttgttgtgatccacatagtcaaagtatttagcatagtcagtgaagcagaagtagatgtttttctggaattccctcgctttttcaacaattgagtaccaccaaaatttttcttgtaaacagaaaattataataaacatagtggaatcaaacacataaaaggctgagttactcacaaagctacaagccatttagattttttggacttgctgttggttagaaaaattatgttgtttgatatgacttgaatttcaatcacgtgtgtaggactaaaaacttggagtttatttcctgccttcattataacccataacccagactgcactaccgcattgttcaacacatacaccttctgaaaggagtcaaaaaaagtatacaaaagctacttgctcatatatatatacatatatatgtatatatatatgcaatgccagcagataaactgcatttctaggaggggcacagaattgagttatgtgactgggtcagattcctgttacttgaaaagttacagaatggagaaaatgctatgacctagtgtataagatggtaggcatgatatctgttgaacatttactgtttttgtaacataaatgataattttctgaaggttgggtgctctaaaatcaaaagagaaacaaataagtgtcccatgttaaacttggtccctcttaatgcttcaaagagatttctgtaaaaaaaatctctttttgagctgtcacttaaatatggtatcctttttacactacaccccattgaaaacatttttcatgaaatacactataactgaatatttgagagaaatatctctcactgcagaaacctatgagagagaaatctgtgttttcagagcttgtcagaaagtcatgccataggttaaaaaaatatataataacatatctagagagggggtcaggaaatagtttacaaagtgtgagaaagttatgttcatatgggaaaataatttcacaatttagcttgatgatgttaataatgtatttatgaaatccctttctcaaaggtgatcagctattcagcttgctttgaaagttacatggaattaatcatggcttcaggataatatatattccctttccaagttatgagaatctgcttaggaggcacagagtgggtggtcaaaagcaataaatgtatttttcatctgtctactcttactctatttttttcagatattttgtcactgtcattagatttgtgagagattttcttttgttctaatttgcttgttttctagtttactgaatttgggagagaaatggtagcctttaaattataaataagactgccaagtagaaattcatacttttgtgaattgctctcttccatcattctttaggaaaatttaaatcatgaagacatacttattatatctcacagtagtattggttgattcaatctcctaattctttcttggaataaaacataccttactttctttcagattcctgaatattaataatagaagcaaatcactgcagcaaattagtgaaacggacacattttaaaacagtatattaaggaagttttctgaagacattgaagtaatatatgttctttttcctaacagttctttagcaagactctttgcaagcaaacaaagttacaaaagtaatgaggagccggatatggaatcttgcacctctgggtcagcagttcaaatctgg

SEQ ID NO: 64840 - DNA, 1837 bp, Bovine  19866880901452
ttccctgctttgaaatgtctaccttctgttgatctaactcagcatgaattgcttgtctttcaaagatcaaaggtaatctcagagattggtaggctatgtttagacatctctaaaaagtcacttaaattttatttttaaaatacaatctaaaatacaatctatattgtattttaagatgcattaatattttcaatttttcttgattaaacacatacagataaacttcccaaggcatctcaccaaagatgtgcatgaagagcaaaaaacccattgaacacacctagcacctaaagctttctccaatacaaaaccattctccaatacaaagaccagggctccttgaagaaatgtctgattctatcactgggcaggaaatatataacaagagccttgagcatcttgtatttccagaaagcaaggaagtgcaaaacaaaatacagacaaatcaaaaaatcccacacaataatgggatatgtaaaatggatatcagtgccaagcaagagttcccagttgccaaaagtggaacaatatcagctaaatgcaaaacatatatacacacataaaagtaaaggaatagtattggcttctctcccaaggtataaaacaaatatccattagtttgtacttatataaataaactactaaataaaaaagtaagtgggaagaagatacaaatttccaatgcagaaaaattcttaatgatttatgcatttattctgcccttaaaagagagagcacaacaccccgcttcttatgtatgggctgctcattgtaacttcctagtaaactgtacactgtgagaagtaaacaaaaagagtgactttacggtggagaaatttgacagaacctcagccaaatgatcaaggtcaacatcaagagtgctaagtcacgctgatagcatgtacctctgataggatattatgagaattgcccttctgtggttttcctctctgaaacccataatcccagtctaatcatgaaagcataagatagatcccaaatgatggacattttacacaatccctgaccagtactcctggaaattatcaacattacacagggaaatttcagaagtttccataatcaacacgagcctaaggagatgtgatttctcaatttaataaagtaatctggatgggatcctagaacaagaaagggacattagggaaaaactgagaaagtttgaataagattgggattcaataatataataatgttcatttagtaattgtgacaaatataccataggaatataagatgttagaaagaggagaaactgagtctggcatatatggtaactctctgtacacttcacaataattctgaaagtctaaaatattctcatatttgaaagaattataactgatcaacttaatatgaatttcagaagtttcaaattcaagcaattttcatcaaaggaagaattttctattgttttctaaaatcacaaccatataggtagcattcacgtccataaattgggtcaataacatgcagatacttaacaaattatttgagtctggcataactgagcagaaatagcaggcggtgcaatttcaagtatcataaataaaacagaaattgatttccagtaattcttctgagcacagtgtgttttgtatttgaaaattgctctaagaaaaaaactaaagtcaaaaactgacctgatatattattattgatattttaaggggagaggtagaactcccaaactacactaattggatttctttctcccctcttctctgagtcacactgaaggttactgttaagagtgtaaacagttctaggtgtaaagcccttaagaaaacaatttataataattctcttaacaaca

SEQ ID NO: 64841 - DNA, 1493 bp, Bovine  19866881136704
gaacatacagaaatggagaccattataaaggttttaagcagagaagggatataatcagatttgcatattaaaaagatgactttgttggcttagttaaagaaaagttgaaagactttagtttaggtagagagaacagttaaggggctatttccatagcccaggaaaacactgacaagggtctgaaaaattaagtgaaagtgatagtgagagaggataaagcagggctccaaagaaaaaaggggctcacatagttctattactgatcttgtctttatttagaaatttggtgttttatccatcatagattttttcattatttttggttaaacagttatcacattgagtattatttatctttaaaaataaggcgggacttccctggttggcaatccacttgctgatgtggaggatgcaggttcaatcactaatctaggaagatcccacatactgctgaacacctaagcccttgtgccacaactactgagccttcacaccctcgagcctgtgctctgccacaagagaagaccccacaatgagaagaccaagcactgcaatgaagagtagcccctgctcactgcaactagagaacgtccatatgcagcagtgcacagacccagtgcagccaaaaataaataaataaaaaatttaaaactctatttaaaaaaataacaaaaggaatggaggtgttgaagatgcctttatttctgatttaggcaaatgagaaaattggattgccctaagatagaaatcttccctgggtggggaagatcctctggagaagggcatggcaatccactccagctttcttgcctggagaattccatggacagaggaaccttgcgtccatggggtcaacaaagagttagacacgactgagcaactaacactttcacaagatagaaatactattagaggaagaggaactttgaggaagcagatggaatataacgatatgactgtgatgtgaagctgctcacatagtagttggctttaatgtggttccccaagataaagtaacagagtggaatggattgcttagtgggaaggtgtatatgaagaaggacttctaggcaccttaaaagtacttctattacacaacacacaaatcagattcaagttagattatataaagagtttttatgctgttttcttaaactattcaagggtgggaataagagtggaccagagggataaagggagataatgactaaaatgctgtcagggttatttacctccattgggcattccttagctattcctgtacacagctatattctctctctttctctttctctctcttcctctttcccctctgcctccgaatgcctctattttgttgacacatgtgaatataatgacagtggggcactttaatgttctgttctggttctaaaagtctgagggaagggtctgatgggccctagtctcagccttcctatgaagcattttcaggcagcagggcagaatcatgttgtagaaaatgtctattccat

SEQ ID NO: 64842 - DNA, 1115 bp, Bovine  19866881475427
atgaatgtactaggtgcaattatgcacttgagttaaatcttcccttcaatattcattcccaagagaatttgagatcatccacctccccctcttccccccctttatatattctcttgggaaatggagactgactagttcattttgattttcaaggtattttcttctcaaagcagttcaataacaaggaataggcatatttccttttctatttcaacttcaagaatttgatcattaaaactatttttagttgaagtttggaagtactgcacatatagatttccttttgaaacatggctttgaaggaagtgagggtcatgtaacccatttatagcattactttatgctctctgttctgttgcaagacttccaaagaattaattaaaagttgataggattgcccctaaaaccaattatcccttctgtctgaaatgctgagtacacattattgagttttcaaataaactgaaaaaaatttcagtcaggcaatagtattatcttaatttataaacattaacacaagaaaatatctgatttgttttaaatgtttactccacattgtattatcagtattatctcttcctgcctgtttaaaagcctaccagaatacattcccaatatataacaacagtgcacaatcatacataatttctctgatattgaatagagtgttctagttgagatgtttttggaatttagagacagcatttcagcagatttatactgtgcttcaatttctcagttgaggaacccctctaacctgtttgtcttttcaatcttgcagtttggaggactgaaggcttcagggacttttgacctttaacctttaaatcctttatcttatcattctaacatgactgttccattttccatataaacatttaattttttctccctccacatatgtgcacacacacacacacacacacaataagagattaatgaaaattacaggcagcaattgaaattacttgcagagttttctgtttcatcatatcttttaaaaaaagtgaagtctttgaaaaacaatagctattatattttagtgtctttatcatggcaagaaactgtgctaaagcccaattgtaatactttcatttaaagatgaagagttaaag

SEQ ID NO: 64843 - DNA, 831 bp, Bovine  19866881926970
aattgcaagtgcatgactgtatacaaaaaagtattgtttatagacatcacacgtgtgaagctcattccttgtgctttcattctgtaactgatttaactacataaatgctattctaaccaactttggaaagtttcaaagatacttcataagatcaaaatttagcagttggtttctcagaaaaaaagataaaaatttcccctttgctcactcagtgtatgaaggaaatgtcattataaaaacttcattaatatgtaaattgcagcattttgattagcactagcagaccccttttgttaagaaaaaagacggaaggagctaaccagattgcaataatttacataataaaaactcagtggtggcagtgccaccaagtagagaacctaaagaaggctagaatgtcttttttaaacagcttaataaagtattagaatcacaaagtacaaaaggagagaaaatatttttctcttaactgacaaactctattttaggaggaaattacaggtactatagattatattaagatgatagaaatgaatatgtagccaatagtgtcaacacacacataatttcaatttagaagtgaatgtttctatcactgctgtttggggacttaaatataaaatatggccatctacttatgaacttgattttgataaagagagaaagcctaagaggagacttcagtttgttctagaaattaccaacctcatgttcatttaagggattaaaagctacatttcaactggatgtaaaaattttaaaaacaaattttaaaaaaaaacacttgataaagtaagatatttgataattcatttcatagtatatatattt

SEQ ID NO: 64844 - DNA, 1196 bp, Bovine  19866881941110
ggagtttgcattttcttagggcatgacccaccagtctccttgcttggctatgcaataaaccttttcctgctccaaactctgacatttcactttgttaggcctcactgtgcataggacacatgaatttgtgctaacagcatggctataaactggggggtggggggcgcaggattagaagttagaaggaaggaagtcatagagggagaatcttagagaactgacaacaacttccatggcctatgtaataattgaagttctcatttgtcaaaaggctttaaactagttgttaatttccagttttagacctgaaattttctgcttttgattataagcttaatttgtcttcacagcagcaggtacatttgaaatatgaagaaataaatcagatacttaatattctttcaccttttgaaagcatttttgcttatagacaacttcttaatctcaagatattttttaaaggctcattttgtccatggcttttactatgtctattacttccatagaaattctcatattttttttctccttttatgtttcctctttgcctattttattattcatttccttctttgaatgcttcagccatgcaaggtcatgcagtgatttcagaagtctgttagtgaaggacttaatttttcaaaggtaaatggagcttaagactaccttttaattggtttattttgcctctgttctttctaaccacatcctgactccacgtgttccacacagttttaggtgttagtgatgtcatgaactacaaactaaaattttggcagcaatacagagaaagagctaattctctaatagaccttgaatatatttgcaattgctaaactaatatttggtaggtgatttgagatctaaaactatacaacatatttacttaggaatagactcattcaacctgttatttaccttttgtccaaaatgaagtagaaaataaaaggctatgtgcatatgaatattgtgctgtgtacatatttcatggtggcagtcaaagtttgtagaatatttgcactgagacctaccatattatacattttgaagttcagctctatttttaagaggaaaacatatctggatgatcaaccatattataatgtggtataattggaaatttacttggaacaataaaaaaacgttggctacagatgtatgccaggggttttatattagaaatatgagcagaaata

SEQ ID NO: 64845 - DNA, 1531 bp, Bovine  19866881966940
atgcaggttagggctgcatctgactcctcataggttgaggaccatagacttgcaatctttcctggatgtcacctaagtttttattggttgattggtctccacaagggccaggagtagtacttgtaagttcctgataggattcatgttaactattttccccatccttttagttttttgtgcaggataagggcctcagaattagcccaccaaaatgtgcttatgagtaaggagaatgagggaaagaacaaaggattggcaactagccaccattttagaaatcttattcacatttcagttatatacctttttgttctactattctaggaatgaatcacttctttatttcttataacttctcctttgataggaaatactatatctttattacaatgttcctttatatctttgtattttcctatttctgaaccagtccccacctgattttctgcttgatattaaggtagagtttacagtgagtaaaatttataatatcaactctgtaaaacaagacaggcaccagatatttagttcttgaattatcacactgagctgaagtcagctcattaatcttctattttcaccccaagattccaaatcgacacacttatgccatttagcagttacagaaatgattaataggtttctttggtgctaacctaattgccgtgacactaaagacaagaacattacaaaagataaagcgttgggaccagaattacctcccttctaggtagcagtcagctgttaaagacaattcttgaactcctttgagcaataaacaaattgttgttgccaagtatggtttttgccttgctggattcaactggaagagtctcattaacatatccttatgcccagctcactgttttctatcttatctgtcgggggaatgtgtaatttccaaaacccaagactgcaagccatgtgacagaagcggtcctcctgggttcccttaccctactgctctccacccgggtgccctttcccaataaaatctctcgctttgtcagcacatgtgtctcctcggacaattcatttctgagtgttagacaagagcccagtttcgggccctggaaggggtcctccttcctgcaatagttctgtctcacaagaaaaatttgaagcatcagacaaaccagtgttacagcccttggatggaccactgttacagctccatgttatactcagttttatttagaaagtaaaggaaaatacatcctcgaggtgtgagagaatgcatctcctgcattataggtggaatctttatcactgaaccaacggggaataattattaaataacatagtgctaaaaaactacctagtccaagagttagcccttcataagtcttcaaaactgttaattgtttcatatcaagtactttaaaattctaatattaaagtaatatgagtgacatttaaatttaatgcacataaagtaaatagaaattagatattgggtgtgctagaaacagaataatttttctcattgtttaagaaatgctgtaaagtaaatgtataacatttttatttt

SEQ ID NO: 64846 - DNA, 1322 bp, Bovine  19866880508833
ctggaccttaattttttcatactgggctttggggtacttgcgagaatctgagaaggaaagaagtctttaattgcaggtgtggcaaagacaagaatttgaaagtgtctcatgtccatctattccttattatatcgttttacccctgaaattaaaagtgaattcaatatttaaatgcaaatataattaaaaatgcaaagactataacaatattaaaaatgcaaagggaatgcaaatataaattatgtcatttacctttttgacgtattttgtctgcagagacttgggctgacataatttcatcttgtttagtctgcagataaaaagataatccctgataccatgtgaattacattgtggaaagctctactgaaccgctgtatgggggaaatgtagctggacttcttactcgtactcacattatcgactagtagtaaagaaagtggaaaaaaaaaaacaacaaccgtacagtttgacctacccaggtctttcacctcgattgagttagcaatttacccctcagcatattttttctctggattgcttccttaaccattgaaagatgaagggtgcagtcggacttctgaaggatgctatcagcagccccttcttcatagtaaccacgctctgtaaccaacttcccattgactctgattgcaaagtccaagatattaaggtctgaaaattgaggttttgaattgaaaggaaaacacctcaattttaactatactgctgcgctttggctttttaacatagttctctaagaatcttttccaggagcgttttcagatttgaggttacttctgccttagttctttgagtaaaagaaataagaatgcaaagctgacagtgctgtgaagaatgatgtgaatatgaatgcatttgtgtaagtgtaatcatttccactgtatgtcttttatcaccatgatgaaaataataatatcatattacatgtttgtgttgattatggagtttaggaattaagtcactgggtgacatgctaccatcttttgctgaagaccaaactcaaatcctgctctcatttaagtggccttttccagttactctagtgttctatgaactctctaaactgtgactttattttctatccttctcacaaaatccattatgtattccactagattgtacaattcatggggccaggccaggcctgacctgttcaccctgtctcagcttccagcacaggcttggcaaggtggttggttctaaatgtctattcattaaaggaatgatgatgttgacttgcagagtcatcattgcatcgttgcatctaattacattgtgagtgtgctctcttcatagga

SEQ ID NO: 64847 - DNA, 4765 bp, Bovine  19866880468220
tcctctcctcttccaatattctctataaaggcagcattcatgttaccagatgcaatcctgagaaatccctgttgggaggtatcttcatttcttctagcacagattgccttgcttggttctccctgaaatatttagagtggctggaagatttctctgagttttctttctttgccctgacttcctcaggctccatgcacctgaaactttgtgggatctttcttgtctctcaagttccatcccctgtttttcttattagcatttgatgaaggcttattgaaaaagggtggcatttgggtagattactcttgtttctactgttttcatagatcctaaagtgtcagtctgtctcaaactagctctttatgtatttgttaaaagttcagttgtttccttcttttcttctcctcctcttattgctttctcaggtataaaagccatattcattccttttgccctatgaggggcacctttcacttttatgatttctgttcataaaaatctgtctagtgaatgttgaaaagctttgataggttacctggcttcctcttattgttacaatgagatagaattctcttgtgatttttgtatcctatgagaaagggaaatatttattaagtaacatgaggtaccatacacacatctaaaaatcttacgattcatttacactaaatttgactgctatcttggataaggttgccagtagttggcagctcatccctgccttgttgttttttagtgtctgattctctcttgcctttattccctacccttgtttttgaagtagttattcttcccttattgtttacttaattatgtagtcaaaagttttgaaattactgttacaaatcagggtaacaatttcttaagagccatattaatctgaaatgttctttattattgtagttgttcagtttctaagtcctgtctgagtttacaacctcatgaactgcagcatgccagactcccctgtccttcactctctcccagagtttcctcaaattcatgtccattgagtcagtgatgagtttcatgggaaaaaaatagtaagttttagctacttaaacttagatgaagattaatatgtctgtgtttttgtgtcattcattggttcatgataaatgtaaagtactttttcctattaataacttgatattttgcaagacagtctcattggttggcaaggtttctgttactgataagcatgtatgtttaatttcatgctctgcaactttggtctctaacccttatttcagttctcatttttagcttaggatgtaactgaaaatgacagtggtgccttggtttaactaattggtgaagcctgaatggaatgtgtataagtgagccatttgggtcgtgaacagaggagtaaagcacacttttctcattagttgtctcccaggctaaaattaaacagaataatatattgccaagttttagtgatgtatggggcatctgttctgagtcaactcagtatcagactaattgtctgcacacttatatgtaaaacttgtgttttatttttaaaggtcttgtctcataaattgaatataatataaaaatatccctttaaatgtaaaagaatgttatctctaatttatagtttcaactaaattgttaaattaataagttgtcttttattacgtgtttagcactcatgaagttgaagcctggctctttgtcatttagtcatttttggtataatgcagttgtgtaacatgaatatttgtgggtgaagtatttaattttttcattataatatagtaagactttcaaaattaattgtccacgtgaaaaaatgtatctattttcatttgttttcctttccctttctctatcattccctttttaaagatgtgctaataacttactgggaaaatttttaaacatttactcaacctgttcagtttttagggcatatgaaaagactattaaaataacttgcctaataaggagaattctataattccgtaatttagttttttctcaagtttgtatacttttaaatttataactactttgtttatatagatttttctctgtatttttatcataattttgaaaaagtttgtacatggcttgtacttgagatgtacagtattttgttgttgttgggttgctcagtcatgtctgattctttgcgacccccatggactgtgtgtggcacactagacttccctgtccttcactatctcctggagtttgctctaactcacatccattgagttgatgacgccatccagccatctaatcctctgttgtccccttctcctcctgccctcagtctttcccagcatcagggtcttttgcaattagtctgctcttcacattaggtggtgaaagtatgctattagagcaaaactgtcctgagttcttttctggttagtggctcgaggtgacctctacaaatgatatgctattctgcttaacccagaaaactaccctaaatcttgcaaatcaagaggttcacatcttcatgttcactttaagaacactcgtgaaactgcccaggccattaaacgtatgcatatctgagaagccaccaagcatctgaaggatattgctttaaagcagccatgtgtgccattccttctggtgcctgttctcattccttggttcctctctctggatttaattaggtatatgagtgttcttcttactctattctcttatctcttaacaccattttgattggtttatttttctatttcagatacattctaaattatcttactgtatttcttctattttattaattttgtcttcacctatagcttatctgctacttgacttgtccaatgagttttccttagagttggtaggtgtgcacaggccaaacagtgggtctggacacagggttggtgacccaaaaagagtactacatttttactgcctttgcttaaaaattcagagagtaatgctgatcgtaaaggcttagatgtagattctctggtcattgagcacatccaggtgaacagagcctcaaagatacaggcgcaggacttacagagctcatggtcagatcaacccatacatgagctatcccttccacattgaggtgatccttactgagaaagatcagattgtttctaaaccagaagagaaggtttcatagaagacaaagatatcccagaaaaaactgaagaaatgaaaacttatggcccagaaataaatgctgcaaaaaataaatgcaaataaaagcaaaaaataaaaaatttgacttttacatctaaaaatcaatttattctttttcttctttatcttcttttatttgtaacacttggtatacatgaagttgttttgaagtaaaatataataaatatcattgaatatgtgctgagaagttgagtcagtttatttgcttttttacacctcaggagatgtttctatttaggattcttttctgatcttcttttttctttagtgttttgtttcttctttgtttgtttaatgtaggtttatttttgattatccagtctgggttcattggacttcttaggtgtgaggcagttatgtatgtacatatatcttggcagttatgtaagattctcagtaattaatttttatcagtattggctcttctcattttttggttactctggaatttaattagatatatgcttgttcttcttactcacttatctcttaatatcattttgttttcttttgtttttctatttctgatacattataaattattgtatttcttctattttatcaattttctcttcacatatctaatctgttatttaacctgttcaatgagttttagggggcttttctagtagatcagctaggagaccttggttcaattcctggattggagagatcccctagagaagggataggctacccactccagtattcttgggctgcctgcggtacaggagacctgagttcgatccctgggttggaaagatcccctggagaagggaacagctacccactccagtattctggcctggagaattccatgaagttttggggggcttccctggtggctcagtggtaaagaatccgcctgccaatgcaggagatgaagattcattcctcgtgtgggaagaatcccctggagaaaaaatggcaacacattccagtattccagacttccatggactgaggagcctggggggctgcaattcatgagtttgcaaagagttggacaggactttgactaaacaccaaaaccaacaataatgagtttttttacttcaacagctaaatctgtcatttctctactttccatttttctttaaaatatgttctttgctaatactttctaatagttgttcatcatgattccatactttagtattttaaacattttcaacataacttttccaacatggacttttttcaactaacctgtctatctaccctttattgtgatttcttttttccgctcctaccatgaggcaggtactttttttagatgctggagatagagttgagggcaaaactgacatattctttccttcatattctgttcgtcctaatggagctaatactatttttataaaaaaatatgtaaagaaatttactatgttatttacagatatacatgacctgccccacatatattaagaatgggacattctagtttagttaagtttatgtgagctacttttatcagagaaggacaaaaatgttttagttagtaggatgggatagaaacttgttacactgcagctttgtgttttatgtcagactgttagcctgcatttcatctagacagctctctctctttgcttctgaacatttaaag

SEQ ID NO: 64848 - DNA, 4243 bp, Bovine  19866880472846
aatacattgcagagattaaattctacaaaacccaccctcccccaatgattaatttcttcctaattttctttctatataaatgttctcaaaataaccattgtgttggcttttggcaaggtatgtttcatatctcatgatgttaggttcctaatcctataatgcatagtgttggtttcaaataactcccttttagcaaatcagagatattgggatagtaggtatttagagtagcttgcctgaaagctttgtttgaaaatactgttggcagacttttagtccctgtcgtgttctttagctgatctagtgtgaaggctttggatgtggatttggccttcaccaaagtaactgcgtcttttgtggcttcctgtagcaggatgtaggtttctatgaatgtgtttctatttgctgccaaaagctacctcaataacagtgttgaaaatgactgtaagttctactgtcatacatttcagaatgttatattaaatatatttaaccctttttattggtatttttgatgttttcctctagaaattcatgttgaaaaaaatgttacaggatgatagaattttggggggtttatatcataattttttattgtgaacttagaaagtctatcttatacttattttaagtacattctggttatataaggtacactggatatgtaatatcttatgtacattcctgattgtgggttttaattgaggcagtaacatcatcacgtgaaattataacctaaacacttttcggcttaaagacaggtgagtttctgggatatgatgagtgttcactagaaccaccgacatataagacagctctttaaaaaacagtaaaacgttgtgctaagtgttattgtaactaaaaagtaatctgaatgtttatttatttatttatttttgtattggagtatggccgcttagcaatgttgtgatagtttcaggttaacagcaaaggaatttagcgatacatatacatacatccattctcccccaaactcccctaccatccaggctaccgcataacgttgagcagaattccatatgccatacactagttccttgttggctatccattttaaatatagccgttaagtacaggtccatcccaaacttcctaactatcctgtcctcccatcctttcccttcagaaaccatcacatgcttattatagttattcaggtataccctgctcaacatcctaaatggattaaacaggagagctaagatgattgattgattgataaaagtctttgctcagctttgagtttaagaatattgtaaagcgtactgcaatggtggctttgtaacttcaatttgaggaagacccattttaccctttcatgactagtgtctgttttcagccaataccttccaatcccctccacaaatacagaagctaattagaaagcaaggtaggaagcaagcatctatgcattcatttaatatgtagaactaataataaattacacgttgtgtaagagaacttgctaaccaataatgagatgctactgccccttgtcattttaacatgagaacaaagaagctattattttctaaagtgccaatttaaacaatagctattaatacttgcatttatctttatatcttattttattctgtgtccactagttcactgccgtgaagtaaactataattttaactgttttgtatgctagaaatacttgctgtctgtttggaaactctgcatcctctgctgggaagaaaggtatttcttcaatgtgaaatacttttctggtacatcatttctcacactgagctgtgaacaaaaacttacttgaaaatcattccacattgacaaggataatgaaaaatacaaatgttgattgtaaaaatagatacaaaatagatcaatgcaaagctaattttttagctttcaaggctggtttgaacttttttccatatctttttattttttattgagttacaacttatagtcaggaaagtacattaattgtttgtatacagcatgatggactttcgcatatatgtgtagccatgttccagccacccaactccctagaaactttcctcttcctggcccatacagtatcctgcactccatagatagccactgttcttacctctatagccattgaacagttttgacataactaaatgttaaaatgaattaagttgtaaaaaatactttctcagcataatttatcatatgtaaatctactcgacatagtcaagtcagtgtcaaatcacagttcaaaataagtgatttcgatcagaattaaaaaaaaatttttaacttcagtttgtcatatcttaatgtcaaattatatattcatccactatgatattttccatgtaagtcactaatgaatataagggaaaataaaagtgtcaagtgtgaatattaaaatttttattaatatgcacctctattcattggacacattccaaggatatagcttaataactctggttataattgaggttttgaaccaatttatgaattttatttattggaacagttatttggtacagattgtcatatacattatacatgtctgtggcatttgtacattaaagaatatactgcttctcaaaaagaaataattatttgtattccaggactttattgtcctctaactgaattgaatgtcatccacgtatgggtttgataaactgacacaacagtgaaaagagtccctgtcccatgtcagcttatcaaacacactgtggacagcacgtctttggcactgaaaaagatttccagtcatttaagttctggatagaagtcacggagctcatgttcagtgaaacacaacctcagtatttccaggtgattttaaataacacctgataaaactgaggtatagtcccactaaactttaagaattatccaaaaactaggaaaaacaataatgcgcatagctacgaattacagtcattggtttagttagcggactgaatgaattttgatgaaatatacagtaattacctaatatcctgtcattctaataaacagcatttttttatactgtaaacatatttatgctgtagaaaaataataaaattaaatgctttttttcctatcctagttcttatcacaacagatatccttgtgggaaagttatccttcaatctgaattggacactaattttttccaacttcatattttatttgaaactattcattctcagaaacttagcagccatcattttgaatagtgtaactgaatcatttgtacattttccagttaagtataggcatcttaatatattcttttaaaatttattcttagtaccataagtatattctggtaaaaatctctaatttataaggtgatatagttcaaaacatgttttcttgtatattatttaactttatttacatatagctataacaaaatagttcaagctgtaacatttatgggtcaacttgcctgatactatatcatataaaatgtgaaaaaatacttttccaagtttattttctgtgcttctaacccttcgaagaagaaattagattaagcggttacagtacctcatcagtggcgctccatctctgtgctgcaggtagaaacgtagtgcatcagtgctgagcagaagctgctcttccctttggagaaaattgcagtatccaagagcttttttaacaagggaccacttttaaatgtgtatggtcacctcaaaggatatgtagagcatttcctgccagcaggattagaggaaggaagcgccaggccaaaatgtttgatgtgtgatgtactgtaattcctttcatgtgtttggtggcttttatatgttgatcaatgttctgctaccaattgtgaccttggtgtggtccaggtcattaaaatttgaccttcctcagtgtgtggggtcattaactatacctagcagcattattataattaaggatgccgttttcttttaaataaccacctctcattttcattaaaatatttatttttcataattggataaacctcctagagactgattttcatgaaagagatgattcagtgtttgaaactgccaatactaacaaaatgtagctgaatgctcgttagggttccttactttatcttgtatacctgctgtttaaatcagcattttcttcccatagtttcctatgagcatgtaaagttcacactggggactagcttttttattttttttttttaattttaaaaattaattttttcttccagttttattgagatataatttacatacagactttgtgtaagtttaaggtgtgcagcata

SEQ ID NO: 64849 - DNA, 2067 bp, Bovine  19866880563887
taactgttgctcaggaggcaggtcaggtggtctggtattcccatctctttcagaattttccacagtttattgtgatccaccacagtcaaaggctttggcatagtcaataaagcagaaatagatgtttttatggaactctcttatctcaataataagcatcagtttattcatctttaaaatgggaatgataaaacccaccctgtcagaattatacttaatataacatacagagctacatttaagtattctggggaccataattagcccctctcgatccagggatcaaacttgggtctcctgcactgcagacagattctttaccatctgagccaccaaaggaagcctaactttgtaatttagacaccttttaaataaactcatactgcaagtctttcacaccaaaccataccaacactagggttaagcacactcaatacatgtttgttgaaaaaaaatctacagatgaagaaagaaatacagagacgatgaaaatgaaagctaacacttcgtgaacaattcttatgtacccgagaacatatatatactctgagaaaaaatatgtatgcactatgagggaaactaagtcagtaaaataggcctatctaacctgttctctctaaagtatctcctttacaagcaattgtagagcaagtccctttaacattcaagcaagtgtattttgagctgtaatttcttctatagaaattaaagagtcaaattgcttgaaacagagtaggggacagaagaattctggtacctccataaacaaatcaagctaagaaatatataactttattaaataagaaaaaggtatttagaggaattataaaaacttctcacctgctgcatatgtttactgcttcgcttctgaggttgataaatgagccaggtgtataagatagggtcaatattaactgctagtccttggacattacaaaggagtacggcacctaaaatgcaagatttttaaattattcctcctaaaaacaataagcttgatatcattttacacctattgcagatagccataataaaaagagaaacaacaataagtgttgcaaaggatgtggaggaattatacctccatacatagttggtgggaacaaaaaatagtgcagaccatttggaaagcagattggtatttcctcaaaaagcaaaataaacagttactgtgtgtgtgtgtgtgatagtcgctgaatcctgtctctttgtgaccccatggactgtagctcaccaggctcctctgtccatggaattctccaggcaagaatactgaagtgggtcgccattcccttctccaggggatcttcccaaatcagggatagaacctgggtctcttgcattacaggcatattctttaaaatctaatctacccacagaagctcagaaagttacaatacgacccaacaatcatattcctcggtatatcaacagaactaatcaaatatccatgaaaaacctgtccacaaattttcatagccacattattcacaacagccaaaaaatgggaaaacatgaatgtctaagaatcgctgaatggataaacaaaatgtagtagaaccacagaatggaaaactatttaaccacaaaatggaatgaagtactgatacatgttataacatgaataagccctgaaaacatgctaagtgaaataagccagtaacaaaaagtcacatattacacaactgcgcttacatgaaatgaccagaacagggaaaaccataaaagaaaaagtatatcaatgcatgccagggctaggggagaaaacaaagggaaacaaatgctaatagaaaggtggttccctggagagtgatgaaaacattctaatcagaaaatggtgattgttgcacaacttgcaaatacaccaaaaaccactaaattatgtactttaaaataatgtgctttatggaatgtgaattatagcttattaactgtgtatttgtcattaaatattaaatataataaactattttattacagttttttattataaaatcataaactattttctagggaaacagcagtgtctatattggccatgagaatggaatattatctccttctttt

SEQ ID NO: 64850 - DNA, 2092 bp, Bovine  19866880568770
ttattaatatatagtagaaagattactgggattcccaggtggctcagtggtaaggaatccagagacctgggatcaatccccagggtcgggaagatcccctggagaaggaaattacaaagtagaaagcctggaatttaattggccctactatttattagcagagtgatcttagccaagcatttcacttctttgagtttctgcttccttttgtataaaacgtaatgattatagtagataccaacaaggttcattccaggtgtagagttttctcattctgtaatttggaattcatctcccccacacttacctttctaaaaaaattttttttttctctaaaaatatttaaactagctttggcctcagagagttgacatctgtaagccactactgtatcagattacagtatatttcaatttgttttaaagatgcatatttatatgcatatttgatattttagtggaccattcattagtttattcaatacttaaatacataaatttaaaaaatgttaatgaagttatttttcaaatactgatgtgaggaatatctgttttaaattggtccacttgaatgaactatccaagtcccattatcaatttagctatccagaaacacttcatgtagcacttttttatcccgaagaaagcaatgttccatgtccaggattcttttgaagccttgaaatagtaaccatgtgggtaagaaaacagagaaaatatgaataaccatagcattaacattcatggggaagagaattagtaaggtaaaggtgaccagttgcattcctggattctgaagtgaaggactatttacagtgtcttaattggagggacaaaaaagggtgtcaccaggcaactttctaagaaattaggtcaaggaaaagttaaaggcatcataagttaaaaattaaagaagtaatatattatgtctttctgtagtgttcatgctttctctcttaatactaaaattaatcctttttaataaggtaactcaagtggcagccagcccttagcagttttagcatatatatgaatttcagtgattgcccaattttagcatttcagaaatgccttaagttgttatggatataatgtgttttcttctttaagaagacaaaaacatttgatttttaaaaatttataacacagtgttgaacttgtaattgtttactgttttatgtgaaagtcataaaccattgttacatgtgctaatgttcctttgtgtggaaatcatatggaatttaaaataaacaaagaattttgtttcactctttaaaaacataccatgttcagaggataatttttcaaaaagtcataattcttttataaatataaaatgaagatgtcagagattttacttagttcattaattaatgagggaaccaataagaatgttaccaaaaattcatatacaggagacctgtaggccctgatcctctcagattttgattctcttattcagtagggtcataaaaatgataagtcacttgatcattgacttgggaagccccaagaaaagcccccatgatcttgggaagccccaaggaaagcttagtatcatttgaatgggatgatttaaggaaaactgcttgaattttgaggaatgaaataagaatactcatttttttttttcacagtagtagatttttttctgagtttccctggtgggtcagtggtaaacatttccacccagcaatgcaggagatgcaagttggatcgctggatcgggaagatcccctggagaaggaaatagtaacccactccagtattcttgcctgggatattccatggacagaggagcctggcaggctacagtctacgggctcacaaaagagttggacaccacaactgagtgactaaacaaaacaacaccaaggtttctctctagctacaattcagaataatttttagtattctgtgtaatttacctgcctgcttctcgtctgtgtttctttgtaatgtttgtggttgctctgaggtttccagtgtacatactgaatctttcacagtcaatcttttgctcggttttcaatctctgactctttgtgaccccattgactgctgcttgccaagtttccctgtccttttctata

SEQ ID NO: 64851 - DNA, 962 bp, Bovine  19866881553241
attctaaatgaagaatctgagtctatgactttgtgaaaatctcaaaatgaagggaacagtatggaggaaaacctgagtcctggagatcatgtttctccataacttggcacctcaaatatggctccattctctggagctcaggtgaaaccatttaaaaacatgctaaagctgacaggtgtgatcagggtcttagctgtgaaattaatgaacagagcaaattttgaaaatagctgttactctctaacacaatattctataatgttttcactgccagctgatggacaattaggtcaaacagatacctaaggatataaaaaagaaacaaagaagtcagatatgtaaaaatcttatagatttgtaaaccatcagtgaaaaggtgataggttaagtatagatctagatgagaatatctagtaaagctatatttgtgaagaacaaagtatatagagaaaagagcccacaaaagatattcaaaaaagcagcaattattcacagaaaatgaatcaaggcaagtggttattccagaagttaagaatttcaaaaacgaatcaatgaatgtcaagggttaaaagtcttccattggatttccatgtaacaggtttattctgttaactgagtaagctgaaagaaatgttagcatttttatatgacaggcatttaaataagaaacataatttatgaaacaagttacttaaaaatatagtgcatagaatatagtatgcactcaataaatatttactttatgaaggaaggagggaaagaagctaggaaggaaaggagaaaaggagggagggatggttggacagagatggacaaacgaataaaaattggttggtcctaagcaatgacagcagactaaagacttatttcagggtaaggtagattcacttgttaaacaagttctttactgaaataaatatatactagatgttattcaggagaccccagtttgatccctgggt

SEQ ID NO: 64852 - DNA, 3391 bp, Bovine  19866880385058
tccccttaaaactgagagcttctcttgaacaagaattaacctcccacattagatcagaaatctgccagataatgtgttttttctgccaatggggggcagggagtgtaaagctcctcagactggaaggaggcatttggggtgctcccccacaaatcccttctttcctgggctcccactgggctgtacacggcatagaaccagttcatttcactggtttgtgacacagggagccagttgactgccggggacacaggctcctactctattcgctggccacgggggctctggcttttaactcaacatctcttaagcaaaaccacttctggctttgtgactgccttcaagttgcttacctccaatttcctctcctgaataacagggatgcttttagctaccccgtaggagtgttgaatggaggaggaaatagccacccactccagtattcttgcctgggcaatcccatggacccaggagcctccatggggtcacgaagagtcggacacgcctgagcacagcacagagcagaggagtgctgaagggttaaacatattaacacgagaccatggttacacagaacaggtcctctggtgctggacgcttgtcctctgccctctgagaaggtgcctctcattccccagctctgctcacatctcccctccctgtcccctagtattcaactccctggacatgtcccgctccgtgtcggtgaccacagccgggcagtgccgcctcgccccgctcatccaggtcatcttggattgcagccacctctatgattatgctgtcaagcttctcttcaagctccactcctgtgagtactctggacttgatctctggaagcttctggccgcaaggccgtccctggagagaggcagctccccctgccccggtgcccttggctttctgctcctatttcagaaggcccgcggagctcccagctgtgttgataataaaagatcgggaccaagccttgctgtgtgcagggacgcacccagcctgccctagcagtgacccaggatgtccctgccctccccctccaggctaccacgttgttcgtgaaccgatagtgatacgttattattcaccgaagtccatgcgttatgcacatttccagtttatgcctaatgacctttttctgtcccaagatcccacccgggtcacggtgttacattcagtcatcaggtatccctaggctcctctcagctctgacggtctccttggacttgccttgtttttgatgacctcgacagttgtttttattacttttttctccactttatttttgggtgccctgggtcttcgttgttccacaggggctttctctagttgtggcgagtggggggcttctcagtggggtggctcctcttgttgcagagcattgctctaggcccaagggcgcagtagtcgtggctcacggacttagttgctccacagcctacgaaatcctcccagaccagggatcgaatctgtgtctgtcccttgcgttggcatgtgcattcttaaccactgaccaccagggaagtctttaaggagtcctggtcggatacctcgtaggatgcccctttgaattactatactttatatgtgtactccctgtttataccgaatgatagtatcacattcaaaaattactaaaattgaaatttaagacactgtagctgaactgcacagaactgtacaatctgggaggtgaatggtccccactctgccagggaggaggccggccctaagaggctgcttgtccagcatcatagagtcagcagttaccgagccagtgctagactggatcctgtgggtctcaatcctgaggtgtttggtccccgaagcaggctctctgggtctctcccagactcatgtctgcacaaggcctcacccagggcatccagtatacacggcccctgggagagagcccccctccagggcctgctctggtccaccctgctgctgtgctcaggggcacaacttccagccctctgtgcccagggagctcacactccaggagcagatagaaggagagttggctgataagcacctccagagtccctgctggccccagctgggcccaagaggttaccagttcccgggcagctctaggtcaggaatgccttcccctgggctgaccactggccccagggaggatggtcccctcccctcccctgccctctgcccctcttcttccctctcactctttgccaattccttccaggtctcccagccgacaccctgcaaggccaccgggaccgcttcctggagcagttcacaaagtaagcggcttgagtgacagaaaagcagtgagtctaaaagtgctgtaaatgcaacccatccttgcaggagcacttgctttgattttttttttatattttatttttggccacaccatgcggcagccacgtgggatttagtttcccaaccagggatcgaacctgcaccccctgccttagaaacatggagtcttaactgctagaccaccagggaaattccaggagcacttgcttttaaatcatcgagggacaagggtacctgttttattgctttaaaggcgaaggaaaagaaggtgtgggcaaaactgccaatgactggggaagccatcagttctctaataaatctcatagaggagggtgattccatttattcattcattgcctcccttatgcccaggacttcatcctcttctccttttctttacctaaattctcctggtctcatgccatgtacatgctgacagctccaagagatgtatctccaaccagacctcacctctgaatcccaggctcacatccccagtggtctgtttgacatctctacaccaaattggggcttccctaatagctcaattggtaaagaatctgcctgcaatgctggagaccttggttctattcctaggtcgggaagatctgctggagaagggaaaggctacccactccagtatcctggcctggagaattccatggactgtatagtccatggggtcccaaagagttggacacgactgagtgactttcacttttcacaccaaatttacatcaaactgaactctaggctttcttcccaaaacgttttcttcccgatcttttttatcgcagtaaatactgcccaccgtccgcttaggagagagatctgaaactcaccattctcctcattgcccatgtttaatccattagcgagttcagatgatacttggtttatctacaaacagatcttggctctcgttctgcctcccacctcctctgattcttttgctgtctaccaggaccctccagcatgggctcagtgctctgctcctgccccctgcaatcccatccccacccagcagttagaatgaccttgtaaaaacgtaacccccttgctcccaacctttcagggcttctgagaacaaatccaagcccctctg

SEQ ID NO: 64853 - DNA, 891 bp, Bovine  19866880504859
ttcaaaagcatcaattctttggctctcagtcttctttatggtccatggaatagctctataattttaccttttccagattccatattgttgaaatcatatagtatgtagtccgaattttcagacttaggtccatttttttagttgaattgtttggttttttattgttgagttttaagagtatatttgtacattttagataactgtcttttatgagatacatccttggcaaatattttctcccagtccgtggcttatcttctcgttctcttgacaatgtcttttgtagagcggaagtttttaattttaatgaagcccaacttatcaattatttctttcatggtttgtgtctttggtgttatgtctaaagagcctttgccatactcaaagtcacccaggttttctcctctgtgatcttctaggagttttatagttttgtatttgacatttcagtctctgatccgttcatccttcacttttcaacccttgtgcattttcccatgatgatccctggtggttaggctgaagatgacttgcttgcagtgtccttttttatattttccaaattttctttttttgttgttttttatttttatattttccaaattttcaacaggggatatatgttattttcatactcggggagagaaaaaatatattcttttaaaaagacatcccagctgtaggtctttcaacccaaagttctcagtgttgacagcctgctttctttcctcttcgtcaaagggccaccggggtgaagggtatgggcagctttgcagcatctacctcaaactgctgagaacgaagatggagtaccacaccaaagtgagtctttttagcaattctgccggccctgccaaccacccctcagagaccaccccgcccccacccggg

SEQ ID NO: 64854 - DNA, 2940 bp, Bovine  19866880510953
agacccccgaggactgcaagaaaatccctgcccgaaaccctgttgcgatcagagggaggggaaaactgcttccaagaactgaaccgtgagccagttatcaaggggatctgctcagaattcataaaacttttaagctgagaatttaatttagagtgatcccaatggacgcaaatgccaattctctccggaggaacctgcctttgttagaattcagagaattcccaccaaaaaaaaagtgtccaggaaaatgagcaactcacagtagaaaaataactcagcacaagaagaaagcacatagcatgagcaaaattcaccaaaacaacagatggcagagacggatctctaaggactttagatactggaagtataaaaagtgatatacaaaatcatgtatttaataagcctaaataaattagagactgttttaaaatatatgcagggcacaataaattataaagaatgccaagcagatctgaaaacaaaacaaaacctaaaattccaagaaatgagaactatacaaaactgcaaaccttatggagaggtttagcaacagattagaccttgttgaaaggggaataagtgaaatgaacactagatggactgaaattacccagaatgcagtacagaggcgaacagggagaaaacaaatgaaatagtggtttaaaggcacggggaatagggtgagaaagttgaaaatactgctaaccagagtctcagaggaaaagacagaatgaggcaaaggcaatatttgaaaagacaatgagaatttttcaaaactaattaaagataatcatctacagattaaagaagtccaaagaaactaaattcacacctagatacataaaaagaacttagaaaacaaaaacaaaaaacaaaacagattagcttcaaagaataatcatgagtctaacagcagacttaataagaacgaaggaagccataagccaatggaagggtatcttgactaatatcttccatgtactaaaagaaaagaactattcatcccagaattcttaagtcagagaaaatatctcctgggaatgagggtgaaataaagacattctccatcaggcaaaagtgcttgtttcccaccagcagactctcattaaaggaagttctaaaggaaataattcaagcagaaagaaagagatcccaaatgcatgctctgagatgtaacaggaaatgaagagcaccaaatacaacaattaaaataaaatatggggtctaaaaacaaccaaaatttaaaatatacgacaacagcattcgagggaaccaatggtgttaaaatattctaaggtctttgtgctatacaggaaacaaagacatgaattttagacaatgataacctaagcagacccttttcatttttagataaattgtcaacagattaaaaaaaaaaaaacctctgcttttatttttgtatcttcccactagtaatgagtgggaaagtgaatgagaaagaaaatacccaatcaatccaaaagaaggtaaacaatgagagaaatagaaacaaaacagataggacaaatagcataaaataagatgggagatgtaagtctaaagatattatccattataataaatgtaaacagagtaaaggtcctgttaaaagacaaagactgccatcttgaatttttaaagaatccaactaaatgctattgacaaatatatttctaagacaaaagattacagaaaagtcagttactatgcagtacatctgaaactaatattataaatcaattacagttcaattaaagaaaaactgaccatgaactagctcatatagcaaggctcaaaaaactttgaaatatcaatatgatattgattctctagccacaatgcaatacatatacatgtaaaaaatatttaaaatataaaaacttataagtaaaaggatggaaaaatatataccagatatattctacaaaaaaagaaaaagacctaagctttccatgttacagaaatgtaacaaaactctctagcatacaggtgggagatttggggataaaactctgctctgttcaggttaactagtcttgtgacttaggaagggcttccctggtggctcagatggtaaagcgtctgcctgcagtgtgggagacaaaagctgctttctctctctgggtctgtatttctcatctataatgggtagattggactacataattgctaacattttgtgagtgcagacagagacaggtaagaattttaaggaaacggctaacacagcagttcttatccagtgggacaaaaagacacatcagcgtccactggggagattcttcaaagagcaggttacctcctgttcttacacatactccttgaatccagagagattatggtatgtttacaaaaacactctttaaacccagatcttgccacctacctcttccctcttcctaaggcaccgagaatccccaaccaggaaagaaaatccactggcattcagattgggaatgccagttctcaaggtgctatgacccccatgggaccaggacaaggaaagaagcaggaactatgacagtgccattgccaagggatcccagtgcccacagaccactgggacatgagcttccattggcaggagaaactccctggccctggaaccttccaacagtttccagggactccaggtaagactgaatatcatggttccatgttcgggcatccccgaacccctccctgaggcttgtgagagaaatccgaaacaaggtgaaagagatgactttgtttcatcccacactccttgttctgtggcctctggggaaggacgaggcggtgcagggggccccaaggagcgggttcagactcacccacatccggctcatgtcgctcaattcacttttgtatctcagagagtccttgagaacctggagagggaagacaaggagaggagaaagaggatggtgaaagccgggcctgaggtggggcagaggaggg

SEQ ID NO: 64855 - DNA, 854 bp, Bovine  19866880851761
tgcgcagagttgcagaaagaaaaatgggcagaacccattggatgaggctgaggacagagttctgagatgagaaaatgttgagatcgctggttaaggtccaagcagaaaggcgttgaatgccagccaaggcattccaaccttggcctgtcagcagtgggtaacctctggagaattttgggcacaggagaggcacatatgttgcctctttcctcctttagttaagggtccaaacaaaagtgatactagattctcattaatcattgagcagccaagctcccagcccagaaacaattgttctcggttctttgtaaagagcacagaccctggactgtggagcaagaagaaccttacccaccccagggagttggcatctgcttcccattcctgctgaaggccagagtagctatttgttctgactgtgaaaaccccactctggtttaaagttctcattctgggggtccttagttccagggtagacctcgaacccaacattgcagccacatccttgaatgagccttggaatttccttgcttatcactgaatgagaaaaagcagattatagtttatcccttttcagcgtgtttcttaaccttttagcctcatgtgtaaaatgatccttgagcatcctcatcaaagttggaaataattcttcaaggtgcaggacctagcatagtaagtcttccatgtgtagtggctgttatgagttgtgtcccactctttgtgaccccatggactgcagcacatcaggcttctctgtccatgggattctccaggcaagaatactggagtgggttgccatttccttctccaggggatcttctcgaccaagggatcgaacccagatctcctgcatt

SEQ ID NO: 64856 - DNA, 1534 bp, Bovine  19866880867737
agaagacagacttaagggaagcagggagtcggtgacccatggctgggggaagggagggggagtatccaacagcgtccatggtgggaaaaatcagaaatggggaagcagctggcattggagggtagtcatctcttccaataagatgaagttagctctgggcagggaggaagaatcaagagaacgtggtgtcctggaattgaaggtgggaaagggttctctgatcgaaaggagggcagaggtgtgtgaaaagaaaggacaggagtggggggacacctcaaggaagaagccaggtgggaaagtgggtttaaggttaagggagggacttccctggtgctccagtggctaagactccaagggtcccaatgcaggggtcccaggttcaatccctggtcagggaactagatgccacatgctgcaaataagatctggaaagtgaaagtgttaactgctcagtcctgtctgactccttgcaactctatgcactgtagtccgctaggctcctctgtccgtgggattctccaggcaagaatactggagtgggttgccattcctttctcctggggatcttcccgacccagagatggaacctgggtctcccgcattgcaggtagattctttactgtctgagccaccagggaagcccaactaagacccagagcagccaagtaaataaataaataactattttaaagagaaagaaaggttgggggacacatgggcatgtttacaggctgagaggacagacggatgggagggaaaattactgaagacacaagagagagtggggataatgacagagcaacgtctcagggacaccagctgggcaggtcaacctcccagcagcgtcctgcagcctcgccaccctggctgcttcctccgtgaaaatccccacctcttatcacacaaactgctgcaaagccacagtggcccgcccgaaattcacatgcctgtaacttttggatgaaactacaggaatttacacttatcctaatgacatctcataaactgtctttatgaccatctgttccagtacaaagaccaagaaaacattaaaccctgtccgggctttgccaaatccctcttcggttcagctgtagcattgggtacatgccagggagtgtgaaaaaaacactgtccctgttctcaagatgcttacagtggagggtggagacaacacaaagacatcattttaatacagtttcaatattgtgacagatgctcgagaggaaggaaggggggcagttcccatcgcccaagaattggctgctagaacccaaagctgagtgaggctcaagtggtgatatgagctccaccttctagagacagctcccaaccagcctcctaaaaggcacccagaccaccaggctgctcaacaaaccaccaaggcacgtgcaggatgctagggctgcccggaggaggcggtgtcactacccagcccagggctcagggtccacggtggctgagtggagttctggaagatgaccagaatccaccctgctgaaggagagcagcaagcgtgttcttggaaggggtg

SEQ ID NO: 64857 - DNA, 1263 bp, Bovine  19866881078138
acggaagtgcccagtggaggatttctgtcttagagcctgaagaactcaccctggaatttagagcccccttgtggactggccaccatctctctgtgctcctctccacctgccggctgccctgtgttccctccgctccggacagaccacactgagaaagacaggagactatagatactcaacaactgataatcccagataacctcccctgactgcgggggtgctttctgtaatcttctccaaccttcaagtttcttttactaattctgttttgctgaagttaatgtgagaatcggtttgcctggccctgaactcacaatagaagcttccagaagtggtcagaggacagtgggacgcctggatagggttcagaatgtactggggataagcaggggctacactgcctgcctggtgggggtgtcaggttgaggaccgccagcagtcacgccctgggtgtccttgccccagggagacgatgtccgtggtacaggctgtgggggtggggccctccttggggtcccaggggtgggatggaaccttccctctaatgacgggtgggggggtgttctttgctgtgagccagccgatcacgggacctgtgtgtgtgtgtatgtgtgtgtggttgtgagcgtggccacactccccagggagcatgcaggcacccacaccaagcagaatccagcctgttgctgccggagttcagtgggccttggtgtgcgtgatgtccgctgtagagctcgctctcagggtgccctgtgctgacttcctctgcctccctcccagaaccccaggttcccaggcaaccttcacatgagtgaccggcagctagaggaggctggagagagtgacgtcaacaacttgtaagtggcccacctcacgccctggacagaggggttcgggagcttgtgtaggtctcctcacttccggttagggtcacagagggcctgaaggcagggccggtagccgaggtggggacagagccgctaagtgacttgacctaggggccacttactgctggtgcctcgcccagaacccttccagggtgtttcctgctccaggcctcccttctctgtgcccctctgccctcccaacacagcgtggaacctgcccgctttctctaccgctgtcactgttgaattcgccctgcttgatctcccaacagccttaatatccacttaggtgggggctgagactcagagctggtatgtgtgttcatgcgtgcacacctgtgcacacatgctttggcggcagcacaggtacactggc

SEQ ID NO: 64858 - DNA, 1352 bp, Bovine  19866880169105
tggataagaaagctgtggtactatacacaatggagtattactcagcctttgaaaagaatacatttgaatcagttctaatgaggtggatgaaactggagcctattatacggagtgaagtaagccagaaagaaaaacaccaatacagtatactaacgcatatatatggaatttagaaagatggtaacaataaccctgtatgcgagatagcaaaagagacacaaatgtatagaacagtcttgtggactctgtgggagagggaggggtgggatgatttgggagaatggcattgaaacatgtataatatcatatgtgaaacgaatcgccagtccaggttcgatgcatgagacaggatgctcggggctggtgcactgggatgacccagagggaggtgggagaggggttcaggatggggaacacatgtacacccgtggcggattcatgttgatgtatggcaaaaccaatacaatattgtgaagtaattagcctccaattaaaataaataaatttattaaaaaagatgttagaatgtagtaaaaatataaatcattatgaaaagtctatagaaacacatatctgtaacaattgcagcactaactgtgtattacatgcctgcctctgttttaagtactttacaaatattattccattagcttgtcaagctgtcctcatgcagtagataatatgttcaccctgttatacagatataccaggataaataacttgtccaggatcaaagagctaggcaatgacaaggtaaggatttcaaaccagagtgtgcagtacagaatccaagttcttaaacactatgctatggcttaaactgttcacacacacacagataaggactggaagataacaaaaacatttaaaaatgattatcttaaggtagtgggaacatgaatgcttttcatcattttttaaattgcctatattaaataatttctaaacagaaaaaaggaaacgatgtaaagaatttgatagttaaaagaaaaaaaaaaacagcctagcttcattcagtaaagactaaagtggactgcgtagcatatgaattttcaaatcccattttgagacttattacctaagacacatctgttattgcaggtcatatttccatgatttgttaagactacacaaaaatactattgctaaagctgtgcattctattccttttatgaattttcagaccaagtaacatatggtgcatctcttataaagtttaatctgaattagttatttctatgttcccaccccaccccctccaacccaaggaatactgtaaatgtatttctaccactcaaagttaagagtactgctgctgctgctaagtcgcttcagtcatatccgactctgtg

SEQ ID NO: 64859 - DNA, 1952 bp, Bovine  19866880768806
catcagcagcacctgtagcttgctcaaactcatgtccatccagccggtgacgccatccaaacatctcatcctctgttgtccccttctcctcttgacttcaacctttcccagcatcagggtcttttccaatgagttagttcttcgcatcctatggccaaagtagggagcttcagcttcagcatcagtccttccagtgaatatttaggactgatttcctttacgtgagatagtaaattaaagaagtaatgaggtttgtttacacaggcatctcagccccaaattgccaatctctggcaatagggtgtccttctaattccagatatagctagggcatctttcatatgggagatttatttccttctttcagggagacagaggatggtcagagtttccttcatcagctgcttcttaagcaacttcagttcaaaataatcaatatgccactgtggcctagtgtggggaatcctgcccggaacccagcataaatagatatgagatataagatagattggaggaatttcaaagatagggaaagtaattaaataatttataatttaagattttctttaagtttgtggttaaagacaaattttcctgttttcaattgtgttatgattgtccctataattttaacatgagtatagagttaattcagttctctgcagtgaaatgaataatacaggaatttctaatttaaattgtgaccattctgacacatttccatttacttttcaaaactgatttttattcataaaacataatatatctcttcacgtgattcctgggaattattctcaggccctatcttcttaccgagtcctgccttccttgtacataagctgccattcttgctgctcctttaggctgacacagttgaataaaaattatcatagtgatgggattggttctccatgccttaagtaaatattggaaaaagccacacggcataaaatgaagctcatgctaaaaatgtacaagtggtacaaagacaggagcttcccaagtggctcagtggtaaagaattctcctgccaatacaggagacacaaggttgatccctggggcaggaagatcctctggaggataaaagggcaacccactccagtattcttgcctggagaattccatggacagaggagcctggtaggctatggtccatggggtcacaaagagtcagacacaacttagcgactgagcatagcagggtacaaaggcagacatgaggacacacggaattctgggaagcaactagctagaatggttggatatttttgaacagcaatgaaattatttgtagtaacaaaggacttgccaatgtagtgagaagttgtttgaaagccatttacttagtcaaaatatttttagtattatgaagttagaaatatataaaaagtggaggaagagaaattcatgatatagacaatatatatatatatatattctatatacatatatattctctattcccatttaatattcttgtcttagaagaaatctttcatttaatggaaggtgaaaaatctagttttaagtaaataaaattaatgctgattcaattattatttatgttggatatccatatttagaaaactttttattactctgctttatttttaccactcattgcaggtacagaaagcttaatatttcaacataaaatttttcattcaaacacactgatatttttagcaatattttagtaaatatccaatttttagcaaggagtctaaatggtgagaaaaatcttatggtgatattctcttatattgaggtgagttttctcctttcaaaattgtgtttgcattttttggcttgtttgatttttcaatatccaaattgtttttgagtagagaccaaagcagaccttacgtcatgctaaaatttcaaactatacttaactgagtaatgatggggtatgtgtatacaattaatatattaatatattatattaat

SEQ ID NO: 64860 - DNA, 1621 bp, Bovine  19866880814446
taccactgagccaccagggaatccctcttagttcccccaaccagggatcaaaccctggaacctcagccagtgaaagcatcctaaccactggggtgccaggaaagtcccagaaattgcagttttctaatgtgactgctagacggggtgtcaacacaatttcaaaattgtccacaatccaggaatgtttgcagcattgaaatcagtgtctaacttaccatgaagaatgcttttaagggaatgttcatgtgtgcctttttaattaatcttttttaagcaaaaatcatatagtactaaccattccttatcctacaaatttcaccaatattagttcattaagctacataactctaggaggtctatactgtcattaactccattttacaaatgagaaaactgaggtcaaataacttattcaaggtcaaacaacaagcattgtgtttcagtgatctcccactcaagttcagctccagagcatttaatatgcttctgtgtggcattgattttactgttttatggctatgcctcctatgcagcatgaattcctagggtgaacccctgcctcccaattcatgctctttcccaaatctgggtatatcagacaagttccatcaagaaaacaggtacttcaagccagaagagatttaatatagagaatcaggagcttccaaaccattagaagagcccataatgcagaccaggaagggctctggaagtcttcaggaaactgggaacctgcagacacgccagcagtctgtggatgcctccacacagcacatcgcacatctgccaaagcacacgtgacttttgcatcgactggaagaacacaaagatatacacaagtatattctcccaggtctgattagaggacttctaaccagcagtcctgcgagtaaacattctggaaaaggtagctcccatgtatatagctcctgcctgacaagggagaacatagaaggcagcagtgatgctcgttgctgacagacaggcctgctggaagtccgggaaagtttgttctaaaacgatcgatactatggctcactaagcaggccagataatgaaaggtctatacgttagcctcagcgtcagggaatcaatatttattagttatttgtcctggaccaccaatggaacaggtgccatgggagatgttagatttacaaccaccttccatattttaatattgatttgactataagtctgggatggccaattcctccctctttaaattcaatacaaaagtgtgtgagtcctaatcttaagcaggagtgaataaatagaacggaaagaaaaatggaaacatgtaaattggtttttctcttccctcattctctgtgtgactgctttcaagccacatttttcaaagtgctatttctcatatttaaaagcacaagaaagtggcaaagggaaatgcctatttttaccagcttttaaagagcacagaagttaaagctttaagtatttatggttttaattttaggctcagatgcaatacagtgacctagaaaggctaatgcttcatggtataaagtttgaaaatattcagctgaatgaatattcagctggggaactccctttggagatggaaaaattcatttgttaaattggactctgtctctgattt

SEQ ID NO: 64861 - DNA, 4296 bp, Bovine  19866880866752
ttgaagaaacataaataactttatcccttcccttcttgcagtcagaaaaatgttgtaaacaatgacaaatcaccgttgcattttagtttatgacaccctgatgccataaacactcatagatgtggaattgtgaatttccagacaggaactccaggctgctagaagggatttgaatcattgcctggggagtgggtcctgctggctttggtgctattttgtagatgatttatggacattcagtgtgtgtacaactggatgccagcactggccaccttgatcctagttcacacctaagtatctgtttgcggttccatccctcatgtattttgtgtttcacactagtgggagcagcccgtcctctttacagatggatgagtcagaggtcaggccaatggggcaatgcctcctgctctttttttttttttctatagcttttctacagccacttagattcactttttctgtgacaaaaatgtaatcttaggtaagaaacttgctttgacgcattctatccacctccacgtcctgtggttgaagctgggtcagcgtccttacatcaactgtcagaaaatagcatgatttttctaaagtgtatggaaaagaaggaaaaaggagaaagaagtgagtgggaggagaagtagcacacgggggtcagtacagaggcacactctttgaaagggcaacaaagccggatgttctgcagacacgacaatattttacacctcaacattcagctatactaaataattccaaggatacatttccagcatatctgagtaatttcgctttgcacatagatatttgggatctgacagaaagtcagtgatagggatattgattcctaaagtagaatttatccaagaggtttcttcttagtctctacaacatcaaatcttacaaaattttagctatcagtgtcactagatcatcatatttctatgtattcccaggggtctacagcatacactaaagaaaatattttaggaggctttctttgcagaaaacccaaaatgaaacattcatgagagctatgcatgcttagaaagtatgtggggtgctgtcgaaacttacactttaagtgacaggtctgcgtcagctcagagtaagctagcaacttcacacgcataggcaaggtcttggaaatatttgtgctttcatattataactattagtcttatcaagaagttagtgtactcatgaagagtaatgttgtactccaaatttccttttagttacctatgaagtagtgtggagtatgcctgctctaataccttgtttgccaaaaaaacatcccatggaactacatctgaatatgaatttctatattgtttttccctctggttgtttaaaaacggttaaacattcagagatgtagggaagcacttacttggattcctcaggacacactgtctgttttgcatttttcagaaaattcaggcaaaagtaggagtaatttaacccttttattcctcttaagtgtaataacatcaggcttcctctttctgcttaatgggacacattggcgacaataactagctaatacttattaaccttgtgccatgtttggtagggcttccaggtggcgctagtggtaaagaacccacctgccaaagcagaagatgtaagagacatgggttctattcctgggtagggaagatcccctggagaagggcatggcaacccattcccgtattcttgcttggaaaattccatggacagaggagcctggtgggccacagtccatagggtcaaaaagagttggacatgactgaagcaacttagcatgtacccatgcatgtgtggtaaggtaagctcataaaacttccttaaggaaaggaaacttgccttttatctatctggggactcccaaagtgctagacacaactgcttgctcaatataaaaataagtattcttataatactcctattcaggaaggcaatactcttttaggaacactttcttatcataaacttccttaaaataagtatgaaatatggatatcagggcttccctggtggctcagtggtaaagaatctgcctgccaatgcaggggactcaggttcgatccttggtccgggaagatcccctggagaagggaatggcaaaccactccagtattcttgcctgggaaatcctatggacagaggagcctggtgtgctacagtccatggggtcgcaaagagtcggacacgacttagcgtctcaacagcagcagcagaagcatcgtatttcttattatcagagaaggaaagctcagttccaaaaatacaaagatcagtatgttagatatgcaaggttaaaggcattcatatctgtgatggaaaagcggacagaggggaacacagattaggttcagtggtgcaatgagggagggggttaagtttttcttccacataaaagcagggcccctgggaagctgtgtgcccataggaccgtggataaagcaggatgtggttctaagaggggatggtaaatgaacaggacaggcttttttgtccttagcaattacttcttcaaacagttattcatcagctggaggaggttggaaggcaattcctgaagatcaccttgtccttctctaccggtggggagattccacagtgtcgccttgaagccaccccccctctgtcgtccataaactgtccgtcaggtttcccttggtgggaggccttcaagcattctcctctgatctcaggaacttcttctgcactacaacttcctaagacctcttatttctttgctgatacctagaaaaaaatacctttaagaaggtgtaggtgtgttccagagagacagttcatacggggtttaacctgaagcctaaataacactgtggtgtgaattgattttagcccaaacttaattgggtctgacagtctgtaaatgccaggtcaccagttcttcagtgtggagtcagggaagctgggtaggcctagtgatttctgtcaaggaggaatgctaaaagacccagaaacagagaggctggagaggggcagtgaggaagagagagagctttgaatatctgatgattttgccctagagagcccttgttttccttccatcaagcaggacagacagctgacgtgcattaaggggatttttgtcaggctactggaaatggcagcatccttacctcacataatttatgaagagcacttcggtttatatttgacactgactttctacactgctcaactcctgaggtcccggagtgtgaggtctgtccatgtcctgctgagcacaccgggtccccactgagcagaagctgcacccaggtctccctggagtcggcctccttgttcccagtcacttggcagcttgttggtcttaccatgatgcatgcaaatatcaccagggtccagggaaagttatagatacacacttgggacttttctctttaatagagttttccatctttggaaaaagaagtcttttttcagatggccaaacacgggattgaaggtgcacattcaaagccaagtgttttgtcgaacggcagctgaaaagccacaaattaaattcatgagtaaaggagcacacgtctagtggtaatttcagatggaagtaagcaggtaattgtataagcatgactgtttgaagagcaatgaaatgcttcttttacttcctgttaaaatgctatttgcttttcaagcacattctccaagtaggatgtgaagaaacaataagttctcattttcatttaggttgtgtactctttgaataaatgcataggttccttttttggcctgaagctgataaaaggcatcattagcataatcatgacataacaatggcaggaataggaataacgctcctctggaaggggccaaggaattttcctaggtagtgggtcagaaatcctcccagtatcacggtgatatttttaaggatgtatgcttaacctttatctgctaatttattaatttagacttcactgggtcttagtagcatgtagatctagttctctggccagggatcgaacccaggccacctgcaatggaagtgtggagtgttaaccactggatgctggttatcagggaagtttccatggtgacttttgttgagggggaaattgagatctgaaggtgatgtgatgcagggacactgaatactgcagaagtccacacagcgccacaaaacccaagaggggcctcaagttccatgcagcatgggaaccacagccacctaaccctttggcactatccacacagaatctccctccttcgagaaacatgctcttgggtgcctactgtttccctctttcctcctagctccgtgttgcggaagctgcaggg

SEQ ID NO: 64862 - DNA, 944 bp, Bovine  19866880936416
catcaaatcccccagtatctggaatggtgcccagtaaataaatatttgttaaaggaaagtgaaaatgaatgatgatgccacagcttcattataaaaatgtaagcttagtatgctgctgctgctgctgctaagtcgcttcagtcgtgtccaactctgtgcgaccccatagacggcagcccaccaggctcccccgtccctaggattctccaggcaaggacactggagtgggttgccgtttccttctccaagtatgaaatgttttaaattccagattggtttctggcagctatttttacatttattggccactttccctgtttgccgataatttgtggtcagcaaataaaaaccagtgttaatattagcctgctttagacacaattagaaaggaaagtctgcaagaagtaaaaatactatgctttccaaaatcgagtctttttcttagagtattgcaatgttctcaaccagaggcaatttccccagctccccacccagcccccaggagatattctgcaatgtctggagatagttttcattgtgaagatggaagggattctactggcctctggtgggtggagacaggatactgataaatatactttggtgcacaggatggccactacaacaaagaaatatccagcctaaaaatgacaacaatgttaaggtcgagaaaccctggattttttgaatcagggtctgtttatttggtgcagacatcaagagatggttttatctttgaactcttttagctctcaaaatctgtatttttattacaatgaatataggtgtctccttaataaaatgaaatacattaggaagtagggaggagaacatgaattttggctcttgaacgaagtatgctctgaagagttagccatttgcctgctgctaaaatgagatgaaatattgaagccaaatttttttgttttctttccagaagggag

SEQ ID NO: 64863 - DNA, 1622 bp, Bovine  19866880942196
tttaaaatctgtgtttccttgcttacattatattaggcttaatgctaagaaatttgacctctagaagctgaatattgtcaattcttgctgctcttcttgctttgatgtcctttccctaactcttgggtgcttctttgttaactttctggatatttcatggccttccgtgtactttcaagcatcaccatgttttaccatgtttccatcctcctgctttatgccataattgatgttacctgtatcccactttggagaaggcaatggcaccccactccagtactcttgcctggaaaatcccatggacggaggagcctagtaggctgcagtccatggggttgctgagggtcggacacgacttcactttcactttcatgcattggaagaggaaaatgggcaacccactccagtgttcttgcctggagaatccaagggatggggagcctggtgggctgccgtctatggggttgcacagagtcggacacgactgaagtgacttagcagcagcagcagtatcccacttattttcagctccactggctgctactgggtaccaagtaactcatttcagaaactcctcgatgttaaagatttcatggatgctgacagattcacatcttattttctcagataatatatgtgcatgcatgcgtgctcagccatgtccaactttttatgaccccaagcattgtagcccgccagactcctctgtccatggaatttgccaggcaagaatactggagtgggttgccatttcctactccagaggatcttcctaacccaaggattgaacctgtgtctcttgagcctcctgcattagcagatggattctttaccattgtgccatctgggaggcccctcagatggtatatacctagaaataaatgtggggttgataaagctttcaggcaaaaaaaccacaaacttttcagaagccagagcagcccagtagggaagcccattttgggaagaacacctttcagatcctatgtataagtagctatctacaatgtccatgctacctcctgccttaaacagtgacaattcagcaggtcagagagaaatctgtggcctaacattctttgaagataattctaagactggataaagttggatagaattaaatcatcatccttgacactgatttaaagtatttacttcctcttagtaggtgatgatttgccattctgttttccgtatctgctaaatagtcatttgtaaattctttcagtttagacaggagaacttgggtctggctccatctcaagttacctcttaatttttattgtgaaatcatagaggtcaatgctagtaactcaaaaaatattgaaaacttttacaggtgatgaggagtggggatgtctttagatttttctataataagctgttatgagaacagttttcagaagcattatttatgggcaaaagaccattaagtagcaaatgttagggtgccagagtatattttattgctcaaaggaatatctgaacatgaataatgtgattaatgacatacaatttactccaagagtttttttttttttttttaatctttgcatagaatcataaatctgggggggggtgtctcgagcagtcattatttattcttcactttagataggagg

SEQ ID NO: 64864 - DNA, 2377 bp, Bovine  19866881129593
gtatttgtataaaaggattcatgtgtctgggtctcctttaacacagcaattctttgaagaaaatattgcttgttttttccattttacagattggcaatctagccaaatgatggagttcattatttgccaaggtcacacatctcatagatggtagtgaggaagcttgggatttccaggtggctcagtgataattactttatctgccaatgcaggagacatgggagatgtggatttgatccctgggttaggaagatccccctggaggagggcaatattcttgccaggaaaatcccgtggacagaggagctgggtggcctacagtgcatgggcttgcaaagagttggacacagttgagcgactgaacatacattaagcttacaccacaaaactccgtttttcaaccaatatgccaaattacctcattttatcgatgcatgaagatgatgagcctcaagtatcttattcagtaaataataaaaactaacatttattgagtgcttcctgggttccaagcttgctctaagcatattacaactcttacctcatttaatcttcatgttaatccattaaaataggtacctttttaatccctattttccaatctaggaaagtgaaatacacagaagttaaactaattcaccccaaaccacacatcacaaagtgatggagccaaaactagaagcaaagtatattgctccagagtatgtccttttaattgctacatataatgccttttccccttgttttaagaactggttgcagaagaggaatacaagtctaatgcattttagaaagatttccaataaagttaaccaaccaataaaaatggaatcaaaaaggaagttctggttgattaatttaatgacggttcaaataatcggatgatccaattcctgagcttctcgtttaattgagtttccactgatttcaggccattctgttcagagagaattctcattcatgggaagttaaatttatcttcattggtaagaaaggcagcaaaaccttgaaggatgctgctagaaaactctccctttgaagcattatgcttttatcaaggatttgtgctacaactttgaagattttcttttgagtgatattcataagaaaccacaattgtgcataattcaaatttgctaagtaagagtccttccatttcaaatgtgtttcttaatgattgaagcagacattttaaaagcattctccagctcttggtgttatagaaatcctaagtcatcatcacttctcctctttgtaggatagaagatcccccaagcttgtaattaatgaaccattaaattcaggcatacggatatgatatggttttcaaatgggaaaaatgggagtgattaaacttcaaagtgatgacattttaccatatcttcctaatgggaggcactcaggcaatgtccttcaaatgaatgaactaatttttctaactaatttttgttctttgaatgtctttagctcagtaaatacttagagtatctttattttctttccttcaagttctattttttttttctcttatgtaatctcctactctaggtctttattttttaagtacatgcttatgtttagtttgtgtgtgtttgctcaatcatttcagtcatatccaactctttgtgaccctatggatggtagccctgcaggctgttctgactgtgggattctccaggcgagaatactagagtgggttgccatgccttcctccaggggatcttcccaatccagggatcactcttgacaattgtaaggtttttagtcccgccagtcattctctcattcattgctcttctctgcttaaagcaatgattttttgttcctcatgagtcctccttccttctcctgttttaacatccattttatcttcctttctgagcatctttccactacccacatgcccaattggctttctctttttagtgagaatacaactaaaatgttactgccaccagaaaaccatcccttttactagtgacatggtttgaaaattcagatcctccagggattaactctcatccagtgctcctgttccaactcttacacttctaactcctacactcaaagaattcaatttataaagtcaacagtaataaaaattttaatttactcattttccaaaactacttatttagtataaaatatcaatgtcctccagccaaagaccatctggaatactaagataattgaacaaatttgtgtttattgcctctctgcaatcaggaagaacacacaccattagggactatgaagcattttgggaagaagatttcagaatggacgtctatgatttctgaaagtgttaggtgatttggaagagggttgaaggcagcgaggttaattactgtcaggaagagggggtaaatctgtcatc

SEQ ID NO: 64865 - DNA, 1564 bp, Bovine  19866881191962
acccaaaaagttcaggctcatctctaaatattaacagcagcagagaaaaccctcagcaatatccattttgctgtgacaatcgaaatcccaagcagatgaatcaaatgagagcagacctcgtggacatcctgaagccccgagttagggtcctggaccaaaattctcacctgtgctcagcagttatcaaggagacctaaagcacacgtgcaactctccagcttgcttgctttcccgtccttctacagaagcttacccaggagaaatggtatttggtttggtctgtgtgactttttttgtaaatggactggatgcctcaaagctcacagtgagggtcttttttttttttctcctaaatccccaaataaacaataacaatataaataaagcttgctttcgcagatgtctggaaacttaacatagctccatcctttttcctttggtgagtcataagatggtttcacagtatctcaaaagctgttttctgtgttgctgccaaaggcattgacaaaaaatagactagctcttagtccataatattttctacattttacatatttcctgtttttatgggcatgtgcaatggagaacagtaaagacttaagacatttgcattttgttatcctttttaaaagagagaagagaattaaaatataccaaagcttttaaatacatagcaaatgaacccatgtggttttcctgagatttgaataaagctaaatactttaaattgaatgactagaaatcaagttttgaagtagaaagaggggaaaaaacttagatcttaaagtactgcataatgttacttatgtttttgaagtgaacatgcagtgaacacgaggcacaatcattttctataaccttctcatgtcaaaatatactccacaaaatgttaaacattgaaatattaaatgttaaagttactttaggagagactacaaaaatttgcaaaactttcatgtgacagttttcccagaaatttttttgtctttgtttaatttgttacaatattgcttctgtttaatgtttcggctttctgactgtgtggcatgtgggatctgagctccccaaacagggatcaaacccgcaccccatgaattgaaaggcgaagtcttaaccactagactgccaggggagttcctccccaaaactttctacttaacttggagcacatttaatcttcccaccagtctgctctttacttttcacatttctaaatgtgtcttcatttctattttccaaaatttctctcccaaatatctgtaaaccagttctaatataggcacctgtaccatcaatctcttctaagttgtttattttttaattgcttcatttttatcactgtcttttggttcactgagagaggagtaaaacttcaaattcttaaattagaccgtttttgtgggaggaaattcacagaatatgtgtttagcttctacaaaagaatcacacatctgcaacccagttgattttaaatatatcttgctgcagaggaccaagaaatataccggtatgttacagctatggttcaagctggtattaagtgccacacaagcaaaactgccca

SEQ ID NO: 64866 - DNA, 1283 bp, Bovine  19866881318589
caatgagaagctctcgcactgaaactagagaggagcccctgatcactgcaactagagaaaagcccacacagcaatgaagacccagcagagccaaaaaataaaataaaatgataaataaatttaaaaaaaaagaatactgagatttagagaaattcagcagctcatgagaagttatactacttaactcctagtagaatctcattaaaaacttgtggactaaatcaatgaacaaacatttaacccacacagaacactgtttcaaatgtattcaaatgttttcatggacaaagggaagaaattatatgtattttaaaggaaaaaaaaaagggtatgtgtcaataaacacagtcatttcaggaaagcatcctaaaaaataagactatttcagagcagtcccaaaaagaaatattcccagaatttccagtacaatctcaattttaaatattctatcttgtcaacacaataactgtgctttttcgatcatgagatcccattttttaatttcagacttattgaggtataactgacataccaaattataaaagatattttaagtatacatcatggtgatttgacatacattgcgaaaggatttccttccattgagttaattaacacattccttgctttatatatttatctctggtttgtttttgtttgtttgtttgttttttggtgagaacatttaacttacattctcttagtttttttctattatataatacaatgttaaatttcaattacagttaccatgttgtatgttagaggttcagatcttattcatcttatcactaaaagtttctacctttttaccaacctctttctatttcccccagcttccagctttggcaatcccttttctactctctgtttctatcagtttgaccttttctttctttaatattctgtatataaatgatatcatgcaatagttgtctttgtctggcttatttcacatagcagaatgccctctgttcagttcagtcactcagtcgtgtctgactctttgagaccccatggactgcagcacgccaggcctccctgtccatcaccaactcctggagtttactcaaattcatgtctatcgagtcagtaacgccatctaaccatctcattctctgtcatccccttctccttctgccttcgatctttcccagcatcaggatcttccaatggtgtcagttctttgcatcaggtggccaaagtattatagtttcagcttcagcatcagtccttccaatgaatactcaggggatgatttcctttagaattgacttggttgg

SEQ ID NO: 64867 - DNA, 1477 bp, Bovine  19866881422157
gaagaaaagggctttcctgatggctcagtgataaagaatccacctgcaatgcaggagacaaaggagacaagggtttgctccctgggtcaggatgatcccctcgaggaggaaatggcaacccactccaatattcttgccaagaaaatcctgtcaacagagaagcctggcagggtacagactatagggtcacaaagagttgaccacgaatgagcaactgagcttgtcaaggaagaaaacctctttgattgcaactgcattattaaaaggcttttaaaccatacttttaccgtgccaagtcacttcagtcatgtctgactctttgcgaccctgtgcccaccaggcttctctgtccgtgggattctccaggcaagaatacttggagtgggttaccatgcccttctccaggggatcttcttgacccaggaatcgaatccacatctcttatgcatcctgcattcccagacaggttctttaccactagcgctgcctgggaagcccaaatcgtacttacctgttttcaactctgaatagaataacaagcctcatggctttttgtctagctagaagatgacttttgtcaaagagatgatctttctctgcctcttactctgctttctggaacacttttcctcgcgcctccaagatcagctaaatgtcactataggtaccattccattctcaccatcacattccaatgcagagaaccactaattcctccctggctatactgaccactattacactgactatgatagcatacatcccattgtaccttagttaatcccctgtgtccttgactattccctctgtataattcttaaatacacagactgtgttttgctcattatctttgtatacgtcataccttcaccttgtctgcttcatagtaaacattccaaaaaagcatactgagtaaatattcgttgtcaccgatcatttcacactatgaaaacaccagggtctttgtttcccttccaccccatctgtgaaccttcatcattgacatctacatctatacatctaatatgtatattagaaattcatggtcagaatgagaatgttaaagactggattgatcagtctttaaagaattttactctgattgcacttttctgattcatcaaatgtacaaaattgaaagttagcatttgttgtccaacagcgtttttaatttagaacccttagccccctgagataactatgagcatgatgtcctagggcatgacattcctggaaagtactattactcattctcgtcaccaatctgcatttaaaggtcaaaatctgaagctccttgttatatatgtgggcaatgaccttggaaaggattgacttttcactgctctcattcatcctcaaataattactttttcctaaataaacttatcaaagattagagctgaactctacattaaaagggttccctgatggctcatgctgtaaagaatcagcctgaaatgcaggagatctggattcg

SEQ ID NO: 64868 - DNA, 1036 bp, Bovine  19866881547007
aaattctctggaatcctggagtgggtagcctctctcttctccaggggatcttcctaacccaagtttcccacattgcaggcagattctttaccggttgagccatgagggaagcctgaatttaaacgctaaaatgcatctactttggatgtaatgtcactttgccctcatcagctattaatactattatgaatgcagatggagggaatagttttaatagagcagttgtgggagaaattagtgaggcactttttcttctgaaggagatgggaatttgacaggcatggctagaggcaaatttcacgtgcctcgtaattttgcttcagactgactctgtgttctgtatatttgctcacaagtgtagcacataaatattcaacaccccaaaataaaaggagaaaaaatttatgtggaagaaagtgactaagggccacaaacctttggaaaaatcagccaggcaagagagaactccattcacctgctcctattagccatttatatgaaatatagaggaagacaaggattccttccttactccagaatttcagcttttggtggaaaaatcagttactggtgataaaacagggtggagccttggattctagaggttggagcatcatcagggaagaaatgctgaagaggtgtgatgagtttcagattctagaaagatctattttgggggagagctagaagatggagaagtggccactagaattttctttttagctttccaaagaagacacacaaaaggagtctttatttgtctttgtttttattaagaagctaagaaaataggtaatgtggaggactatagagtaaggtgtcatgatgggaaaccagtccagagtggttcatgtactaccagaataattcaactgaattaaactgaatttattttatccttggtctttcattttctgagctccaaaatgtatttactcctactgggagatcctcttgggaaatattttgaattcaaataaaagagctaatgtgttaaatatgagattgtggaaataaattttgagtaattgcaatg

SEQ ID NO: 64869 - DNA, 1124 bp, Bovine  19866881747264
atgtcactttctctggtcctcagacttctcctctgtaaaataaagatggatctaaaaatgatctctgtcttttcttgcttaacatgcttgctttgataagattatccatctaaaagtcgttccacttcatcttggctactaagccacttttaggaagctgtcattaggctgctttctgcacccatgagtaatagaaaatttaggaagtttatatatatatatatatatatttatttaaatatatctatttatttggcagttctgggtcttactcgcagcaagtaggatctagttcccagaccagggatcaaacccagaccccttgcattaatggtatggagtcttagccactgggccaccagggaaatctcagaaggtttatatttttaatatattttaaatcaggagctggcaaactgtggcctgctgcctgtgtttgtaaatagttttattgaaatacaccttacacatgggcttatatacacatctttttattgaaaaagttttattgaaatacacctcacacacacacattttgcctatggtggctttagcgctacagggcaaaggtgagatagtcggaacagaggctgtaaagcctgcaagcctgaaatatttattatctgcttcttttcagaaaaatatcttcaaaaaaattttgaccaatgctttaaattaaatataactgtttaacaaagcaacaaagtattccatatcactattagtctatttctaaacctaatgtgaaataataaagccaacttcaaagtaatgccaactcagtacaattatacatcttactcataatttcttaataactatggagaacatttatttcattctttcctctgtattgctttaaagagaaaccttttaaggttttctttgggagtggggatcaaaagctcttggactcacataaatctcccctgctcttgaagttatactcattaccactgatctcatcctacttttactttgcaatttaattaaaccccagaaaattttgttctgcatttctctttcagatcatttctctttctattttcttgatggaaagacaatttctagactcccctttagttacacacattccatttttctaaaacaagcgttctctgtga

SEQ ID NO: 64870 - DNA, 1095 bp, Bovine  19866880573763
tttgtgtcttgctttttctcccttaatgctttttttttttcatgaacatttatctattaattttaagttctgttaagttcagttttccatcctgtgggtgtaagtttcttttttttctcttatgttcagatacataattcaactgcttccattgctgatcactgactttgtttcagttctcatcattatgataaacatccatacacttaaatccttgccttctagaaagacttttcttctactctcagttaatgagagtgcctattaatatttatctttaccagcattgaatattttcattttcaaaagtattagtatggtatgtttattgaagtgccttatttaatgggctaggtaataaatctgaaagaaactgatagcacttggtagctctgaattcaacagagtcctaacagcataaaaagcaagacaaattagattacatatgctggaatgtgcttagtatataaaattttgttttaaactatagtgtagttagagggtataaggaaaagtcattggtgatagctacatgtctatggaagaatgtattttaaactgtgagatctatattttgatctagattgtaaactcataaaagacatgtttgagaaagaagcaactataaatttttgtttagaatgccatgtcttatgtatagactgtacactctttaagcctcgtaactttctcagtgactaataatgccagaatagccaagtaagtcttttcttgactaagccagtcttttattgaataagcatttatcaagcacccattataaatacagcattattttacacaacggacacacgtgctgatgtcctaacccagtgttatagaactaatacctggagttgtctctttgtttctcagtataattcttatttttccacagtctaattttcttgtgtttctagtatttcgtatttcctgtatttctagattttagactcatggtcctataataattgtatttgctcaggtcagtccttttctgaacagattgaaaaaaaaaaatgaatgtgtgtctgtatataaaacaagcattcacataggtttaaaaataaaaaacctttaaaagtcaaaaagcat

SEQ ID NO: 64871 - DNA, 2208 bp, Bovine  19866880848440
ctttttttgagacccttttattttctagatagtgcaacgttcttatgagtgatggggactcatcctatgctgaatgaaaatttctcttgtcatagttgaggaatgtcatgatgctgaaccatcagggccttgaataacagtgttgcaacacctggggatttcttcatcgttattagttcccccaaaacatcttccataaaagaatggcctgcacttagttgaggatacatatgtattagttcatgatgctaatgttgggtttactctgatgaaagcctataacaccagcattattttgagataaatttatttagaacaatgtttctgcaactgtaacgtacatgcaagtcacctggagtcctgttgaagtgcagtctctgactcaggagtctgctgtgggcctgagaatcttagttgccactagattcctaatgacactgaagctcctggtgcacggaccatacctttagtgagacttgagaagagtgtcttgtcttgacttcagtgtagtttgatatacagatttcaaatacaaagggttttatttgtttacttctacttttatgagcgtgaatgaaccaaaaaccatgtgatttattttcttccgcacacagtatagcaccttttgggctctaatgcttggttgttggtttgcttcagtttatattctggggcaactgatggaagaactgaagagactgtggtatgaaggcagaatatgtgtattaggtaggtaaagatttgaaaaatacagtctgttattggtaaagctgaaaagtacagccaggggccctttcttgacatacgctccagcattcagattttcattttgaactaaggagaagaactgttaaaaataatattttattcccacagttggtggtttcagttcattagatatcattttagactatttctctttgacattcttcttagttttctactctgatgatcaaaagagcagaacagcacttgccctttttgactgcacatgcttttaaattgcagttaataaccacctctgaattgtaatgaaaaaattgctctaaaatgcaactctttatttctttttcttaatgtatttgttacaaaaggtaagaaattgtaaatgaccaatgaaaacttgacttttagagacagacttgttattgtcatttaaaagaacaaaaatatcaactttttagagtgttttaattgggaaataacagagaatgggagaatccattttctcctaacctcttagtcctgaatttctcatataagtactcccacccaaagcaaaagcaatcgatttttgtttcccttgaagcttttatgtttttagtccatttttctttttatagtaatgcattttcaaagtaaattactgctgctatggtgtgtttctttaaatacttgacttaatacttctataaggcaagaacattttcctctatagttcaataactaaatctttaaaaattaatagttacctaagattatctgttacctaggccatgttcagctttcctaaacatccttgatatttggttttataaggtaggatatagtccagaatcacattttgcatatattgtgtcccttaagtctcgtttaatccataacagctttctggtttgggctttttcccccccatctcagtgatatgctaaagagaccaagttagttgccttacagcatgttccactttctgggtttctctgattattcctttgtggtttaatttaacttgtttctctcctgtatcttatataagctggaaattgggtcttgagacttgcttagatacaaatgaaatgctcactgaatacctgagaggtgatgtgctctcgacattggatcgccacttgtccctctgttcatagcacagaagctgagcaccagaatgcaagggtgatagctgatcccgtcactgtaaaatcactttgatttagtgattagaaaattaaaaatgggttttgtggcagactatgatgtacactaaggcttattcctgaccaaagcagctgtgataacatctgtcctctatgactctgggccagaaaaaaggtacaccttatgtagtagtattatacatccttcggagaaggcaatggcaccccactccagtactcttgcctggaaaatcccgtggacggaggagcctggtaggctgcagtccatggggtcgctaagagtaggacacgactgagcgacttcactttcact

SEQ ID NO: 64872 - DNA, 2140 bp, Bovine  19866881141694
ctctgaatatattaagaatcatgaactgtacactctaaatagatgtgtatataaattatatctcaataagttatttaaaatatttttaatatttaatattacatattaaaaatatgtaaaagaggaaataaaaaaaatacagaaagcatctggctcttagggtcagctaaaaatacctgtcttactgcaggagtcttcaaaattctacatccattatgttatttttgcacaggatccttctttcagttggaccaaaaaaaaagtgatttaaacattgtacttctctaaactctggagtaataatcacatacaaaaaaatataagatcctttgtcttttcttgatgccattctgggggtcttaactctttcacatgtttagatatcaactattccaaacctcttaaaatctagaatttcttaaatttcttgattaaaaaaaaaaaagtcatgaattcaaatactgtcctaaatgtcagatggacactctcttgtaattcagccctaagtattacaggcaaactaaacaactagttcacaaagcaatttttgtgatatatgttgtaaaacctttaaagaataatatagaatgatacgattatttaaacatggccacctacactacctctcacccacatatgctggtgtccaacagtccaatttgctagcaacggtgagcttttacgaggcagcctgtggaagcaggaacacaacgaaggttcccttgtgctccccagctacacgcccacggtggcatgaggcacagagcccgtgccaaccacctgaggagggcagaacccctttactcaatgcagacgagagacgggagatgtcttgtcctttatgctgctactcaaggcccccccccatagcagaagagtccatgtttgattcttaaaaagaatcaattcaacaacatcttaacccctgggttgctgtgccacattcagatctttcctcacacctaggttttggcctcttttcctcagggtcaaagctcaccatcagtctctcacttcattccagaattaacatcatggatcaagaaaaagaaagatctgttctctataaggaagaacacaaatctgttttgtaggaaattgttatatataattacgcaattttaaaaaacaggccagtaaacttgaggttaaatttcaacatacaaagaaatacaaaaagtagttcaacaatttcaacgcacacacaaagatctagaaaagtaattctaacttctaatcttaaatatatgtctataaaagtcttgtcaaaactttaaaatataaccttaggaaatgtttctctttactgaaggtatcagttacttgggtattattaaaaagtaaaaaaatacgtcaccaatactgtaagacccaaggctgtggagagatggcccctcagcttgcttctaaaagtctcttctacctgaatcataggaagcagtagggctggagttctagtcccagggctgcctctaaaaatctctgtggtcttggataagttatttaacttttccaagtctccattccttcaccatcagcattttctaaacattctgtccaaggaatattaatctcataaagaagtgttctgttttcaaattaagtcagagactgctacacaccatttcccctcttcaggaggttcacgcaacacgcattagcattactgaaggctccgagaagtcctgcagcatccatcctggttgacctcaggatcgcttacctgctaacactgcagcatcctgtggactacactttggaaaacactggtccagcatatcccaggtctcttccagccctgacactgataacaggcaggaagagcagtgcactactttgttgcagcttctgaggtttaagagaggctttaatgacctggagttgacaaggaacttattcacattaactagacctttgaagatcaacacgattcccttgttcctaacgagagtcttcattcaaggaatcgtcacacaatctcagtggccgcctacaggacaacacacagaactgaccaagaaggatcagttatcttcaatgaagtttagctttcctttccggtatggtttgatgtttctctgtggcgagcgctttggccactgttccttggacagttctgcccgcccgcccatgcccactt

SEQ ID NO: 64873 - DNA, 1594 bp, Bovine  19866881223836
cctacctgtgccctgatgtcccactcctcctccagagctcactcagctccttacatgtgatcacagtatcatgtgcttctcctcataacccttttctgagttgtaactgtacactgacaacttgactgtatgctccatgcagggtgatgtctatttaatattatgttgatgtagatttatccactctgcttgacacatagtacacactcaacaaatactcatggactagtgggaaaatatcaatactttaaatagaacattacacaacaaatatttattgaacataatctgtgctaagtgccaggtgtagggcagtgaacaaggtataaatgtaaactctgcacaaactatccttctaattgtatgtatatgtaggcacctgctgggcttctctgctgggctcagctggtaaagaatccacctgcaatgcaggagacctgggttcgatccctggtttgggaagataccctgcagaagggaatggctatccactccagtattcttgtctgtagaattccaaggacagaggagcctggcaggccacagtctttagggctgcaaaagagtatgtctgactcttttgcaacacacaggcacccattatattggtaattatacatgcatacttgtaattatatacatatgtatattataataagatacttgatcatggtataggaataagtgatgggtatgtgggttttccaagtggcaccagtggtagagaatctgcctaccaattcaggagatccaagagacatgggttctatccctgggtctggaagatctcctggaaaaggaaggcaacctactccagtattcttgcctgcaaaatcccatgggcagaggagcctggtgggctacagtctatggggtcgcaaagactcggacatgattgaatgactgaaaatatgtgtacttagtcaaaggctgaaggtctttctttttcttttcatgtgaaagaataaactgtcttataaaagaggcctacaactaggctgattaaaacagtggatgtccacatttggcagtattgattaatgttaacaggctacacttgaagataaatatccagtcatttatgaacaaacaatagttcaatgaatagttgactgcagtttgtattttgggggggcatcctgaagtactattcaatggatccccagcacatgtgcacaagcagataacaaggctcttgggtacccacaggcctatctcaccagggtgagaattagcatataagccacaaagctcaaagagtcagtcagtggtgctgccatgccaaccacagcacagccaaagggatcaccaacagggactctggaagacatcaagcttctatcgccaaatacagctggccactagcccatctttgtagaacacagcataagactcataccatatgtcagaagagtaaattggggaggggggaagaatatccatttagctgtgtatgttttctacagctactaatatttccttctattttttctgctagaaaaagaaaaggtaaaagtgaagtcttagtctctgctggtcttaagtcattctttatttgctgccttcaaatctttcttctccaaagaccaacaag

SEQ ID NO: 64874 - DNA, 3143 bp, Bovine  19866880733523
ctaaaatatctttctacaaataataaagatcaaaatcaatacaaaccatttggctgctcatataagtcatccttgggctgaattaaacattactcaaagcaaacagttatcatttatccagagacgaggaattaagtaaacttagtacacaaaaaagaacaaactgcttttaccctttccaaattacaggtgtgatacactggtacctaattatcattttataatatgcagtatcttatatacagtacaatgcattgtttcacaattgtaagctgctttgttttgttggagggatagaggtgcttttgttttgaatatgaaatattataacctaaagactattctaggaaagactttttcatatgatatgtgccatcatttgtcttaaatcatgaaggagatacactgtatttaatgtgacaaatgttaatgaaaattcttagcactttgcatctggcctctagcaaatccagtttaaagcaacagggtttacatctgtggagatgaggatgctgaaaggtatcacattatatgaatgtcttttgtacgcctgctagcaacctaagagcacagtaacagtcaactaaatttttatggttctaaaaaaaagtaccaatattaattatctcttattttatttcaaagttatggtcaaaatgttcaacagaactgatgttattaatgtaaaattaatctgctaaaataagttttaaattagagatcttagttaacactggaaaattcaaaatcacattctctttcttttcagtgtgttattgctgaaccattccatatattgctttgacaatattccatgcatctaaaatacataaatcaaatgagatttcagttagaaaatgtgtgtaaaggaaaaaaaatgcagcttttattattaatatgtattttcacaaactgtgttgtggtttaaaatgtaaaaatatacacatgcaaacacacacacacacagtctctacctaatttgttgagttaatgttccttctcaaaaaatatatactttgaataagatgaattaaatatggttgtttggattttagaatgcaataaaatgattacattaaaaatgaccatatttaaggggaaaatagctaagttgggctaatttattattactactcattgcatttaaagaaacttggaccagagatcaaagtgcattttgatttgtttgaaaattgtaaatgacccagtcccagatttccaaccccataaagttagaaagcagtctgtgagtactctctgctctaatcaagaaggaaggggcttcagcttcaaatgtcaatgctgtaaacatgttaaatctggaaaatattttctaagcaagcaaccatgtgtaaaatttactgaacttgtcatgaaagggctgcagctgcaaacctacaaacttctcacttccatgaagactccagatgccgggacagggaagcaagattttcatcgtgggtccccagctgttgtaccttagagcattgcctgccgccatcttttaaacaattttttaccaggtaaagaagctgtgatcatttaataccaggaaagaaaatcctggcttccttcagaaggtgctccatataatttactacagcattgccaacccaaacattcaaccatagattgagatttgcaatccttccagctgcccagctaaaccaagttagtttagcaaaagctttcaaaatgcagaaggaaaataaccagctaattatagaattaagcaattgtcatgtgctgttgccaaaaaagattcccattaaattatacttatgcattattttatgaaactttccgaaaaatatgtttgctgcttataactaaaaacatcttgggataaatttaaaactttgctttactacagaaacataaaatctgccagatatcatcataaacaaagacaatttgacgaattttaaaaaattactaacactccttttaacactactagcattatatgtgatatttacaatatgcaatcttcttttataatggaaaaggggtttttaaaatgaaatctgcacttaaatgccaatatcctctccttctggcttctcactttatgacactaacataggatctcattcaccaagccaattggaaattttaataaaagaaagcaggagtttctaataaactcctgcagtgagctgataatactaaacatctttagcagcatggtgttttttattattattttagctgtatattaatatgctagtatttgtaaactccccagtgccactagatttatttcagaaaccttcactacattcctccattgtgaaaagtttatctgacaaagaaaaattctttttcgatgattttccacccaatgactactcaacaggaaaagatatggctgacaaatgtgttgcatctatgcgttcagtcctggaagaaagagtaactgattttacttattctggtgccagttctgggctaaccaagaaagctggtataatccataactgctagagaggcattatttgggcttttgttagaaatgtagcaagatatactgagctacatctttcaccaccatgtctccttgctaggtttatcttctagtccatccctctataccttcagccccaaatccccaccacacctcccaactagactgccattactcttctattggagcaataggggctgtggctgcatagcttccacttaaaacatagtatataaggatccatgtttacaatgtagtttggatatggagttcaaataaaaccatggggcacagtttttataacactggatacgatgcagaactgtcaccatcaatagcagtgaactgttacatatacttcatgtaatgagtcaacagttagatagcatttactgcatgtcaggtactgttctagccacttgacatgtatgaacctattcaatcctttccacagctctgtgtggcagatattattactgccctcacttcatagaaaataaaaccaagaaaggaacttgccaatgtcatgcagcttgagaatctgctcaagattcaagcaagaagtctacagagtccaactcttcatccctctgcctctgtaaacaatgctgtatgacaactgaaacttttcactggtaccacttctctgaataacacctattccattacttctttg

SEQ ID NO: 64875 - DNA, 1595 bp, Bovine  19866880839717
gtgaggaaaatgaggcacagaagtgttaatcaccttactcaagaacatgcaataaatcatgggcagagctggaatgcaaacccgtataacactgaaagcacacttacccagctggctctatcacttaatgctactgccaacaatatgtaaaactactcctatttgtatttttactattctagacatgtcacccattaacttactttatcttcattacaaccctatgtagtaggtactatcatcattacctgtaatcttatagatatgaaaactaaagaacagaagacgaactctagagtttgtcctcttagctattgtactattccaacaatgtttttaaaagcagtaatggaaaacttaaaaataatagatacaagtacttgagagatttttacaagctagctacaaaatactttttgcacattgcctttattataatcatagtaggtgtgaatagtttttaatcacattttataaaggataaaattgagacttagaaaaattaagaaattttcctattatctcattaatctatactgttggaacccaggattcaagactttagggactagccccaaagccaaactacaacactgaattcgtgtctatgaccataacacttcttcactctttcattcaacaaatatttattaagcacctatgtattgtgtggagtttcccaggtggctcagtagtaaagaatctgtctggcaatgcaggagatgcaggaggcatgcaggagacattcaggagacatgggtactatccctgggttgggaagatcccctaaagtaggaaatggcaacccatttcagtattcttgcctggaaaattccctggagagaggagccccagtccatgaggtcaaaaagagtcggacacaattgagcacactgagcttgcacctacacgtgtattctgtaccaagagatacctttctatgttttcccaggtggattgtaaaatagaacataagattttctcaaccacagaaagcctctggaagaatggataaatggtggcaaagatgttcaaacaaaatgcagtggtagtttgacaatgatcattctaggcttgatctcagaaaatatttaaattaactatttccattttaaaataaaatatttaagttcacaagtagcagcaaaaaaaaaaaaaaaaatcccagaaatgcatataaaaactgaacaggatgttttaatcactaatcttcccacaaagagacctctccccatttcaataactaagtctgtgaaaataaaatgagactacctactgcagtgttttgaaagtatgttgaatagcttctcccactatttcacttgcaaagtgaatgctaattggataaagccaaggtctttgggatggggaatcttgctgggagtaaggagtaacaacaattataaagccagttactttaaggatagcagatgtcacaggctgtcctaactgacgagcctttgtgtgatcaactgtatcctttctcttcttttgacctttaatttacttctgatattttctacctgcttgaatgcactggacttttcatttcaaggaaactagtatcatggcaaatatttacatttattttgtag

SEQ ID NO: 64876 - DNA, 3056 bp, Bovine  19866880925452
taagtgaagggctcttcagtcctggggaagattcattatcagtacttttctaggctgtgtgacatgggagatttggtgttgattagcagttgatgtggtgaggagaaagcagaatgacaataaggaaacctcttaggatatgcaaaaaagtgcaacccacacaagactgccattcattagataaatgtgatgccagattttgccaaacagtaatatagagaataaatactcaagacatagaccaaagtccaaggagaggcattgagtcctgttcatggctttcaccacctcctagggacaccatttctctagatgaaatttagcttttagcagctacgttatgaggcagggttactaatatgactcctttgaatatgaaaaatagaaagaaacccctttttaatctttgtttttatggctgcaaacatgattacatagaggaaaatcaatcccaatggagcacaatggataatacaaagtaattgattggcctttatcattttctattacggtattaaaataacaccataacatcaagcagcagccactgatacataaaggaaaacaggagttgattatgtctaagggtaatcaggtcagggaagtgtgaaggtaagataaataaggtaaatacaaaaacagaaaaagtcttcaaagaagcaaaagggagttggtggcagagagtcggcacaatagaagggaggtctgcagttggcaacatcattaagcagtaagccacgagagaccgtctactgcagctgtgtgattgcagtatgtctcggttggtgtcccaagccatgggggcaaaagctgagcgacttcaacttcacagaaagtgcaataatcctttcagaatacaatgcctgcagcctgactgccatcaggctatgaaattcagaaaatgaaggagacgaagcatttagctcttggtatttcccaggcactaaggccaccagcatggttttgtgagcagccacttagaaaaccttcatttgcagccaactttgcaaactgcccgagacaagcgaggctttgtcagctccccaaatgccatggtctgtgtcctagtggcaagtagctgaagcagagccctggagaaaaattccatcagtagaatgcctaggtgtgttatgctgcattcttgcctgttttatctctccatatatattcattctctcaacaaatatcccaagaatactggagtaggtagccattcccttccccaatatatttattctctcaacaaatatccacacttactaatgcttgcataaatgttactaattacattgtttgatattaaaatatgaccaaattttaattcttaccaacatttttattctttgaaaatactttttgggtcaaaatacatatatgcacattgtgtctgatcaataaacaaatacactcagggactagtttattcaaatatacaagatattagttctgatctctttgtcactacctaacactcttctaatttaaagttaacataatgaaatttatgttaaccatccagaaaagccttgttgttgctggaagtcagtttttcacattcacacttaaaatacagtataaaaatgtcatgtccgccagagtgacccagtcttaaggataagcagtaatgagaaatatagcttaaggtgatagaataagtcatcatgtggggtgggagcataagagagctggttagctgtgacaccctcaagagatgtgagaagtagtttcttactcagaaggactcttgataatattggatttgtttctaacttttctaaatcctggggggttgaactcctttgttcattcattcacttatttattccagtaattgaatgcctattatgggtctagaacgtaacttggtgctgtggttacggagatggcctcaaggagcccatgggcttttagagaacattgacatatatggacagatatacgaaaatgtcctggttgacgtgactcaggtgctatgaaatatggagcaaatgagagtgagaaaaaggcttcacagaggtgagcatggatggaaaagtagatttccagacagaaaagaaggatatgggcattttaggctgcagactttcatatgaatggctcaaaagacagaaagagaggtgctgtggaacagagggaagagcagaatagtgcacctgtgcatggaatgaatggtgggagttggacaggatggcaagtgaagcccagattcccaaggaccttgtctgccatgctagagagttgtccctatacgaaatataaagcctgtaggggtgtttaagcagaggcacagtctgatatgatcttggggtggtggcatttgggtatagggtagagcataggtaggagtggggacgagagaggccattgcaccgtatagtaatctgtggtcctggttgaagcataataaaccacctatgctccatgcagaggggattgcatcagaattatcatgccttgtctgtcaaatgctcccggtagcaagtgacagaaaactgaaaggtatcatctcatctaacaagaagttcataaagccatggctctgtgtgtggtctgtcagggtcaagctccatttctcagctgttctcttagtgatgcttctcccatgtgttgtctttgttcttgagctggaggcagcatgactgcaatgacccagatggcaaaaaatctacctgcaatgcaagagacctgagttcaacccctggcatgggaagatcccctggacaagggaatggctacccactccagtattcttgcctggagaattccacggacagaggagcctgatgggctacaggctatgggatcacaaagagtcagacaggactgagtgactaacactttcactttcttttcatctagacacactgtgtccagaggaagaaggaccatctttttttcctaatgtctcttccttaggaatgaggacacctttcccagaaattccgagcaggtatccctcatgttttattgtctttgttaggtcaaattcccattcctgaaccacttactgataaaaactcacaatggacttggaaagtcaactattgtgcctgtcc

SEQ ID NO: 64877 - DNA, 1152 bp, Bovine  19866880951960
agctagcatttgttgagtatctactacaggccagactgcacactgctcgcttttgcacaaatcatctcaatttgtaaaatgtgatagcaatgccacctagcagggctgctgtgatgatcaagggggatgctacacaggcaaggggtccgtgtttgtacaaacagcacaggcttgtacaaatattaggggtgtgtcattttctgttttctacatcagtgcttccaaatgatcaaactgtaattttgaccttagaaacagccactcatctagttttattctctagctaaatgatccagaggtaatctaagagttatattaatcttccccgagctcagctttaaacctagcactctcctgctgaataaacaaataaacgtgaaacacctggaaaatatccaaaacatttgcatgatgcatgaatttaagggtttccacaatccagcctcaaataaccttaccagcttctcccaaagtgacttagcatgcacccacatacgtattctgcatcaggttttcaacaaagcgaaataactagtcagcctcctttccaaactctggacttcacttccttatgtcctatactgggaactcccttctttggtctttgtaattgatgatacatgtaaagaatttagcccacagcctggaatgtggtatgttctcaataaatggtagcggctattatttttaactcctactcttaccatgaccatgagacctcgggtagtcttatggaaatgttccctcctctaaaagccttatgagttacgatttcaccctcctctacatgtctgtagcttaatatcctaaactctgggggtatattttagtgattttctatgatatactgaaattatatacacttatttattcaaaagacacctaagcatctacttggtagcaaagtttgtgttggaagggatacttggacaagatgtgttttccctaagggagctagcagtctaatgggtagccagacaactaatcaggtgttagttgtcacacctacattgtaaagaagcctttccctgcttttagtagcagcagcagcagcagcagcagtacctctagggtctttcctccattcagcaggtaaagtgcacactctaaaaggtccatcagatcacatcacttcactactaaaaagcgtgc

SEQ ID NO: 64878 - DNA, 3116 bp, Bovine  19866880955217
tggatcctgaggcactgaaacgatacataatgacaggacttttcagctagtcttaataaaggagattaaagcaacgtgtaacataagatgtgtgttaataaaacaagtggtgaaaaataaccaattgaagaacctaataataaacgcatatctttacatttcaattagctttttgctgatgctgtcttttttttcaacacttacaaatatgtcacaaccatagaaaaatggttattaagccagagtgttcttgaaaatatgactatttcagttgccattttaaaataaataatctttctcatacggtaacttctcattcaaagctattgcaattagagcaagaatcaatcactgtgtgttcagacaccgctcaattttctagagctattagcgcccacagtctgcctcagagggttggaattctgagcagaaatcagaaaggtaaaggctggagatgcaaactggtgtatatagggtggctaaacagtaaggttctactgtataatgctgggaattatattcaatatcctgtgataaaccataatggaaaagaatatgaaaaggaaggtatgtgtgtgtatatatatatgtgtgtgttagtgtgtgtgcgtgtgtatgtataactgagtcaccttgctgaacagaaaatgttaattcaactatacttcaataaaaaaaataaaataaagaaatgtaaaagctgggatgagacatcttggggggggtggcaatagtagttagaataccctttattggtccacagacacgtgtttatcatcagcaagaattcagcttcctattaataatatcccttgaactttgttgctaaaatatttcttccaagtgtgagtcagattcttggtttgagtcttttgttctaccaatagttattttcacactaagatgccgaacatttagctgtttccctgcagaagaaacgctgagctcacagaataggactttgttcccgcttctttacccagttgaacaatagcaacgtgaaaagaaacagtagaagtcagaaagcagaatgatggcatcctttggctattactctatattctcctcatcatacaaagtgtacatctggtttaggtcttgggtccttgtttctgttgcaatatcagaatgttaggaagtagtttttacttataaaaagagtacaacagaaagccatgaaagctgtatcagtataaatatatctaaaaaggattatactaagttataatacttaggcatcattcagcgctttagataggatcagaaaatcaaatttgggacagtgcattgatctgatgaaagaacaaaaaccctaaaatatctcaaaatttaaaatcagaacattgccagaagtatgctggctttttttttttaatgttataagcccatgattagaaaacagataatttaaggattcatagtttatttcactgagagaagaaaaagagcatgagagcaagatcacttcagagtgaggcggccaaatctttccaaactgattttattatttaacctctgtggatttttttcttctatagtctagatgatcagcttgatttagacatatcttttttatcttggtaaattaaataaggcttgagcaatacaaaaatttaaataatgtttttattctttaaaaaaggttatctcaggagtttctttacaagtttatgtctgaatatttcaaccttgattttggactattatgaaacagatgcttttgttactgttaaaacaataatccaaaatatttccacgtgtcacatacaataattttttaaattatatacaattcaggtaaaattggtatagaaactaaaatgaagagaagagttaagcaattatctccatgggtttaattccatgagccttccaaggctgaaagcagagtctcacacactattttctccttaacaggataatggctattaacgactcagggagagtagctaagaagggtgttttgaacagactgagatcagctaaagtcctcacaaagtgaatgacacagacattgatcaattccctaccagctattcccacatattcacccccattatgattagaaaatataagatataattacaatgttggccaagtgaagctgaacctattttatcctgttaccaacaacttccattccttgccgtacaacccccaacacacccaaagaaggtatattttcctagctctaattttaacttgaaaaatcacacctcaagaaactcaatatcctttttaaagagtaagaacaatcaaaaagatgcataatatattcagttcatagcagagtgaatcattgaggtaacttccaagatatgaaaatgtatctgttaaagctcagatttggttttgtcagaagtacagtattaaaaatagaaagttgattatataactttgggaggagaaagtaaggcattagcaaacaatgaaagaaggaagaaaataaatccaaatgtcatctttatgaaagtataaagaaaggaggtacaccagaacgagagtgtaagtttccaatcaataactaatccacaaaagtgatagatgcattttctttggaattaatgaagtacaagttactgataaacaccctggaattacctagcaccttctcacaaagcatcaccctaggcaactttatttcttatcatgactgtggatttagaagagcagatatccttagcaccattttgcagaatgacaaagctgaggcctatatttaatttcctaatgttaacatcaaattagccctcttttttcttttttttttaatacccaaaactctcacttaaaatataatacacagtatatgtttcttaagtcgtttcgaaagttgaaacaatttaacaactaactatggaggtaagtacatgttttaaaaaataattctccaagtccattccaaacttctttgtcaattattttaattatggatactactaacaatcaaaagactatctcagattggtcaaggtattcattcaacaaataatagttgacctccattgcgtaacaggcatgcagatataaagatgaatataacacagtttctgccctccagaaaatcacagaccagtgatgaaagacaatgtccctataattataaaattccagca

SEQ ID NO: 64879 - DNA, 1075 bp, Bovine  19866881039352
cttagtaagattctcgctataattaaacaatgcagagatgaacatgaaaggccgaaagtcagggcttgttgaaaagagagtttagagaagcctgactagagtttgggaaaggacagacgctttgtcaagtaaactagaatagtgaggtctacttgccattccactgatgctaggtttgtttatgacttgctttaagccacagacgtattaggggatgtgagactggcaaagtctttaaatatgcttgtgagtttgcttgtgtccacttgggctccttcacttgtcattagaagagcaagttctaagtagccattggctctttgcccagagtcccagaatgaggaacacagaacagatacgtctctaactggaagcttgtagccgacccgagtcaaaacagagtctgaagcagaagtgtcccagacaacctgcagacctgtgagtgagaataagtccttattgttgaatgcactaaatcttagggtagtttactgaccagcattaattgcagccacagctgcctaatacaaaatgctctaattaacacttccagtggcctcaagactttgatttgctgctagcatttatcacaactgtaatccatctatgttttgttaaccattataatttagcacagggcatgtagtaagttcttaataaatgtgtgttgaagaataagtttctctatatttcatatcatgcccaactgccttgcttcatgtataatgttcttagtaagtcatcttgaaaatatgtgactttgtttccagctgtgtctatcctcaagcatttatgatcctcagcagttgataacacagattaatacatgtggtgaaaaagaagtgtttaatgagtgcaaagtttgggaactgaacccaaactgacagtgatgtcattaggggatgaggagggtagatgtcccagtgaacttcctggggaagaaatgcttgagccactttagagatgtccaggccaaattctgaagctaacagtagttgttaagcatttgcagtaactgttttacatatgctgtctcacttgagatagatatcctgattatacctattttacaagt

SEQ ID NO: 64880 - DNA, 691 bp, Bovine  19866881409947
ttcccctattcacgctgaattgtctgattccaatttaaattgctagtcagaatttcacagctttgcacaacactttctaaccttttcctcttgggcatctctatttgaaatgaagctttactgtctctcatatatctgaaacaaacaagtgtacctacttgatggtttaatcgtaactggctaagctcaaaaaaatgagcagcaagttcaggaaaaatgcatgggacacaaccagtcgacagaaccaaaaccctcagcagagatgcaaatgatattttattatttgaaacagctgccttgcagtctcagacacttattttttctttacagatttttcctgaataactttgtgctggtgtggtatattctttcatgctttccctggtgaccacagctctcatgccatttaccttgctccaggtaatttggagaaataccacagacacatatcattacagggtctgtatagttgtttagctgctaactgattctcaaaggaagccgacagatactgtcactattatgtcatatttaaaattcttcgagataagcgtgcttattttagtgaaattaaaactgctggattttctggatattcaactataaaaaggtttacagaagaggttataatcaatattgcctttactagcaaaagaaaagaaaaaggaaatctatgcacatttttaagatt

SEQ ID NO: 64881 - DNA, 895 bp, Bovine  19866881503261
tgatctgccgagggcatggatggaatctgatatgaaggcagcctattgattctttagattacctccttgggaaactaattattgtttaatctttatatgggtggatttttgtatttgaaaatctactcttttttgtcaacaagagaaatattagttttgatcctcaaagttcttgcctctgattttaaagggatatcactttagtgctccatcctttatggtatcaataagctactggaaaaagtggcaaataaatcccatagaaagtagttaaagaagatcaaacataaccttcactgcagaagtagaggtgtctattcttctttacttgaaaaaaagatcctgacttggagatgccctcttcttttagagagtctgacatgttcttttattcttccactaatatttacatgaaaatcaacttttattgtttgctgcaattgattgtgagctttgatatatagggggcagatttcaattacaaatcaaatgcttgcttagtagattgttaaccagtaatcactttaaaagcacaaataatacaatatacttggtcactggagaaggaatattaatgaattatgaacttttaaggaacaaggttgctaagaattttaagataatttaatcttgctacagtgcattcagttgaaatatgctttaaaattactatccatctttgctatttgggggttatttcatttttcagtaacgtgggcagagatttaaagatacttaagaaagattatcctttgaagtatatttcatttatctttcttttaaacatacgaaaaataaaatttaaatttaacttgtctgggtctttgaaatttctgaatgcttatcttttatgtgcaatatcatattttcagttagagttttcacaacagaaata

SEQ ID NO: 64882 - DNA, 1041 bp, Bovine  19866882222289
ctggatgactaggggaatcaaatgatatgtggatgtgaaagtttataatacttcccatttatataacctcatttatttgaataactcaatgacctttccatcaattattgaattaaaccttttaatattcctctgcaaaatgggaagtgtgcatttactctttattttatggttggatgatggggtcatgatgatttgaactgcttttctggggtgaaccagaccttacattcatgctttggatacatagttaaaggctgcttcctaaatgggacacctataaataaaatgtccttttttgtgactctgatgggattagggcagactgcctccaaatatgccactttggcatattgattatttagaattaaagttacttaagacatagcaggtgccagaaggactcagtgcctcctttgtccgtctgaaggcaggaaataaagtcccgaggtgaaggcagtcagtctccttgcacctggagggtggacggcatccttaatgccagagatagggaattcaggactgagaaagctgtattaacaaactttgttacttctgaattatgactccaagtctagaaaccctttttcatttcttcacaaataatttttgtctgtttaaaaatataaagtttcctgctttggtcacttctttgagtctcatattcttatgagctcctgtgcatatgaaattaaatttgttcttctcctgttcttctatcttatgccaattgaattactaggccagtcaaagaacctagaagtgaagaagggaatcatcttccattgtataccgctgtacattctcatgaacaattcatgattcctgtgcgtggttcctatgcactttctttgtataaaggctaaacaaacgtagtttgtgtctgtgtgtgtgtctgtgtgtttgaggtctgattgtaaaactagagattttccagggtgaatgaattcctagtaattttatagcatgaaatctaatggctttcattttcagtgctgatcaagtcttattttctagtgaggaaattgggaaaggccgctt

SEQ ID NO: 64883 - DNA, 1257 bp, Bovine  19866880773141
cttggcaggaaaaacttgttgaaatcaatgaggataatctgaaaggggcccaggcctggattagagacattaaggtaagaaagaggctgggtctgggagaagaacagagatcaggatagaaatgcttaagaaactgctttgaactccaaggatggccatggtttcacatagacatttgttttacttacaaaggtcatgttaatccaatctttttagttgatatctaacatttagataggcttctactgacaacactgccctcagttcaagtctcagtctgtttatgaaaacaaatttcaaaatatagtttttttacttaaacattcatatttgtttcttctgagacttcatccttgtttcaaatgatatattacagctattttaaacagtggattttgttcaaaagtaatgaacttgtggaaatacacagtataatgtgagtggttagggctgaaagccaggacagagatagggcagcagggtgtgatgaaaaggtaaaatcacttcttcaggggtctattttacttggagaactttatatctacacagactactgggaagaatttcccttttctcaagttttctgttgtcttgaacttaccttcattttaaaagttctttttttagaatcacatagcattccacatatttaagatatactaaaattgagaccaaggactattcttaaaaagtcaaatatggatcatgctgctgctgctgctaagttgcctcagtcacgtccgactctgtgcgaccccatagagtgcagcccactaggctcctctgtccctgggattctccaggcaagaatactggagtgggttgccatttctttctccaatgcatgaaagtgaaaagtgacagtgaagtcgctcagtcttgcccaagtcttagcgaccccatggactggagcctaccaggctcctccatccatgggattctccaggcaagaggtacggagtggggcgttctctaggagctgcaattcctttgttctttccttttttcctttactctggaaattcctaacttggatttggagcctaccacatgtgctttgtactgttgtatccgttttctacctgtactgaagctcactttgaaatagctccgtgtcctattttatcttattctgtgttcttcatttatccaataatgcactcagttatcatcaggacctctgtgggtcaggcattgagctagtgctgggggtggaaacacaattgcctttcaggaagtttgcagtgagccagaggg

SEQ ID NO: 64884 - DNA, 2866 bp, Bovine  19866880899380
ttgtgactgctaatttaaagtctttatctgattattccaatgcctgagtcatctcaattctgtggtctgtcgattgccttttaccttgagaattgatcatgtttgtgtgctcttttgtatgttgcattttggcttgtataatattatacaatattaatattatataatactccacaatattatacaatattaatattatataatactatacaatattatacaatgttacaattatattaaattatattaaatattgtgttttagtttaatatattaattatattaaatattgtgttttaagactctaggtcctgtttaaatgctctggaaaggttgccttttttggtttcattttaacttgattagattaggctctaaattctgcctcattttctatgtgcagcagttccccatatctgtccaagtttaaaagcctgttccacaacagagagtcctccagagtgagcatatagtacatgcgtgttctgtaattcttcagtgacatagttctcatcagagaataacaaactatcttgttcctgtgattattaatgttttatttatttattttttagcaacagaaaattcaaggaactccaacaaagaaaaacaaatcaaaaaaattggatccactcagaggccagaaggttattgcaagatgtgatgaaaatggcttttattttccaggtaggtagatattttactttgtaaaattcctttgttaagtaatacgatatcggggaccagaagttctcaaactgtgctttccctatcactttgacacctcataagccgtactaaggtattccacttctaaaatgaaaggatgatgaggtttctacccatatttgtggagaagtaatcgccagaaaaacttacattaatctttcatttgtttagtaaacaagttttttattacatatttactatgttccatgtatgtaatattcctaaagtgctggtctaacacagtaagcaaacagaagaaaattcttgtctttatggagcttacatgctagtgggggagtcagacagcagctgaataagtaaaatatgtagtgtgtcagatccagggctatgaaggaaaatggagccacgaagagaattgagcacatcaaaggtgaaggttgcaattctaagtatggtggtcgatgaagagcttatgggtaaggtgatatattaatcaggactttcaaaaggagcaagaagggatttcctggtagtccatcagttaagactccaggcttccactgtagggggcatagatttgaaccctggtcaggaagctaagttcccacatagtgtgtggcacagccaaaaaatttaaaaaataaaatttaaaaataaattaattaaaaggggccatgagattatctgggggagagagttctagcaagggaagaccagggcttcactagaagcttcactagaagccctgagaatggaacgcctatgacatcctcttccttagagggagaggcaaatgtgtctgggacatgatgaatcgcagatgcaccatgagacactaacgttgtcagagacgcagttggagatatggatctagagtctggagaggaaatctgtccagagacagaaatttttgacacgtcagcacaaaaagtactcattgaaatcatgtaaaagcctatggggaaagagagcttaaagaacccagaagaagagatgtcagtcgaaaagattataccttgaagtgtagtcaatcctactcccagtcacctttttaaaaaaattatttattacatttaattaaatctgctttttaagtgggaaaagtacttaaataggaatttgggtttctagcagacatatgtgtagaactaacaactaggatattgtatttgaatttttttaccccttccaaaaaggaaggccagatagaattttgaggagcacaggcatgatcttcattggtgactcctttctgataatatttgttcaaagcctcataaatgtttctagagaaaaacagctaagcagaaggcagcttcagagcaattggatcaaagcgtcctttgcttaaggccaggtctgtgcaggagcaaagctggctcagttcttgctgccacccttgggaatcagggcagggatttccatttggctacctctgttccaaagaattgatgctttcaaattgtggtgttggagaagactcttgagagtcccttggacagcaaggagatcaaaccagtcaatcctaaaggaaatcagtcctttattcatagaatattcattggaagaattgatgctgaagctccaatactttggccagctgatgcaaagagctgactcattggaaaagaccttgatgctgggaaagattgagggcaggaggaaaagggggtggcagaggactagatggttggatagtatcactgactcaatgaacatgagtttaagcaaactccaggaggtagtgaagaacagggaagcctggcatgctgcagtccctggggtcacaaatagtcggacacgaccaagtgactgaacaacaaccaccacctttgctccagggatcagtgtggattagctagtggaggtcagactgtgttgtgcagaacagaagtgacaagctgatagcctggttcatccggatgctgaaaatcaggaaggcggacacatttcagaactttattttaatcattatttgtaggaactgtgtcatctttcctgttgttcagtaaaaagcagcattttatctcaggaagtcctcaatgatgaaaagtctgggttgcaagatttctgcactatgccatcagaacaagttacaacaggaaaaaaaaaaaaaaaagctgggggtgggaaacagaatactttctcaggtgtaatgatttaggaccagaaaaat

SEQ ID NO: 64885 - DNA, 639 bp, Bovine  19866881010630
tgtcttcttattggccccaggtagtcgaaccagcggatcacccgtgtctccaagtccttggtcaccttgcggaactgcatgtactgcttgatggaatcgatcttggcctggaactcggcccgtgaagcattcatgtttgagatcatggagcccacgttgcccacgatggtggcaaaaatcaggacgcccaccaggaagtcgatgaccacaaagagatattcctcgtcttttacggggggcggggtctccccaatggtggtcagggtcaaggtggaccagtagagactgtaaatgtactttctggagaggcgcccgtactctgggttggagacgtttgggtagacccaggagtcggtcccgaaaccaatgaacttggaaatggcaaagtagatgcaggcattccagtggatgatgatgaggatgtacaagaccaagttcccgattctgaacatgttggggtagttggtcctcgtctccgtgcggtcaaagaattcgaagagccgggccaacttcaggaggcggttgaacctcagttctgggtagttcatgcccagcttaaaataagccaggtctgtgggcaccagggacaacacgtccagcttgaagtgcaaggtctgtgtgtagtgcttccacagccgg

SEQ ID NO: 64886 - DNA, 971 bp, Bovine  19866880517373
ttcagctgaaatagcctgcctttctgtactccaggtgtgtacagcacatttgctttcttggcagaatgtaatttggttcaaaatgtaattcgccttggaatcaagtgttcaaaattcccctataatttttgatgcggttcaaaattttctccttcaacaatttttatgtgactcccccatttaaagtctagatcacttttagggagcagtaagaaaattcacaaacaagatatagcttattctttgaaattatattttgttttgcttctctattaatgcaaccaaaaagatttcaagttaataatcatcaggtttgtatttgatttatattgttataaggtgttaaatccagtacttaaataatcatcacattgtgatgtttacaagccagtttttcctcccaaactcttttatctagaagtgaacattttaaaatatggccctagagatcaaagtgcccattcttacttattttattagatccagatatgttgcctttatcctttaaaaagcactgactttccatttaattcagttttactcctctttaaatgtgtgattctctaccttaaataacctcgggatgttttcctagaaatgcagtcaaccatctgaaagtaatttttctgtctggtatgtggggagtttgatgggtgtatgtgacatgcttataacttaacattccttactatactcattttcatcaaaatattggctaaaatattcagaacagatgtgtatttgtgtgtgcgtgtatttttctagagaaagcttcttttgtgagcaattaaaaggtacatcagacataaagagaaatttctctgcagccttttttcccccagttctttggcaactgtaatagagaagattacttctcagatgctgtatatcatcctgaaacgtaatgattttagcatgttggggccagagttttaaaaatgtaggggagggatacgactaaaaaggcagca

SEQ ID NO: 64887 - DNA, 600 bp, Bovine  MMBT19771
tctaattgtgtaattttctgcaactactctgggacaaaaatcttggtaattggatttttttaaackaacaagttgtcacaattggatagttcttaaactatttgtgcttatgcttcagaaattttcagtggatgtacagtgtattttaaatgttttgcatcagcttgtggtctcaaatttgatttaactttgaattttaaaatagattgacaactctgattatacattgtcttcactaaatggacctttgctaagttttgagtgtrttcatccctaccccactctctgctgttgtcatgsgagctaaaatcctggcggattcagctccacccccaagtggttctgtctcccagagtgctttgctgttactatggaaatgcctgcttattaatcttgctgtccttttactaccaaagcacctttaacygtctcaagcaatcaagtgacgttacctacagcaggcaaaggaagaagaagactgctttcgcatcctacaactgcaatgctgattttaatcaagatttaatcaaggagcagaaggaactaaagctactccaacagctctttaaaaatatacaaagctggatctttctgatgcat

SEQ ID NO: 64888 - DNA, 600 bp, Bovine  MMBT08985
ctctgcaccctgactttcctgtcaagtagtttataataacagctaacatttatggagtgtttgcaatgcactgggcttcatgccaagcgctttacacaccttgtcttaattaatcctcccagctaccccccaaggtgtacatatcattacctccactctcctagtggaaactgaggctcagagaagctaagatcaccccccctagaaagtggcagggccaggatatgaaaactgcgcttaaccaccatgctcttctacttcccccctctaatctgaaaagaaacccttaggtttggggcwtctttgtttatagactgaagccccgtatcttttttaaagactttttttgatgtggatcatttttaaagtcttgattgaatatgttacaatattgtttctgtttaatgttttggttttttggccgtgagacatgttggatgtcagctccccagcgagggatcgaacctgcaccccctgcagggtgaagtctcagccgctggaccaccagggaagcccctgaaggcccctattgtaatgtgtatactgtccccatgacttagatgctttgcaagttcagattttttatattcttttgttcag

SEQ ID NO: 64889 - DNA, 600 bp, Bovine  MMBT21228
cttctttcccccattccacgtgtaggcacagaggcctttaagcagcaccacttgtacctgagaagccccaagaagctgagctggcaggagagctccaccatctggtgctaaaaaaagtcctgaggttcataaccaccatccggttcttggcctttacatagccacctctcgctgaggtcagggaccactgagcagcggctgctaccagaaaaccacagccatttctccccatggggtcattcacttgactcatgtgctaatcatctgctctgcattcaggcctgtgaccacaggctcttkmtaaggttgcccaggtgtcctagtcctgacttcacctctgatttggtgtgtgcccttccctagctgttgcctccatatgtccstgtggatgaagcgggggtgcagcgggggaggggggctgtatgatttgcgagggctstgccattctgcttctccctgtggaggtggtctgtacctaaaggatgacctccagaaaaagccctgacacaacatgtatttcccttcccttctgaaattgctgacttaagactcttcctctttggcaaaggtgccaggtagcaggctcagaggcacagattc

SEQ ID NO: 64890 - DNA, 600 bp, Bovine  MMBT12147
catacatgcatgtgtgtgcagtcacttcagtcatatctgactctgtaatcccatggactgtagcccaccagtctcctctgtctacgagatttcccaagcaagaatactggagtgggttgccatttcctcctccaggagatcttcccracctagggattgaactcacatctcttacagctcctgcattggcagacagatactttaccactgagccacctgggaagccccctacattccatacatatttggttcaaactgcacatagcggccatttctaattactattacttaataaaaaayacttttataattatgcattaacttcccaatcatgattacagtcactggtactgagcaagaacattaaaaatccaagactaggccctggagtcctgattagaattgtacagataaacttacaggttggagagcagacacaagccaagtctgtgtgccatattttaatggaagtttgcagtaatccatgcgagaatgaccaatatttctcaagttcttctggaactaatggtctattgcattttgtatttagagttatcctaaatcatacatttggggtatgccagtgcaaatataaaatgt

SEQ ID NO: 64891 - DNA, 600 bp, Bovine  MMBT00059
tccctaccccagtacctcagaatgtgactatacttggccacagggtctttaaagaggtaacagggtaaaataaggtcattaaggtgagctctaagccaaaacctctaaagcgcttataagaagagatgagaacacaacccacaggtaacatacagggaggaggccgcctacggccaaggaaagacgtctccatcaaaggagataaggttcgtaggtcgggaacacacacatgctactcttctctgctcctgtggttctcccccacagaaccttaagttggcctcagaaacctcaaggaartacttcaagctgccactatcaaccaaccagggttgacaggtgagctaatcaaatgacaggagagcttcctgcttcgatgcccggatgacccactgggcttcactaaaccccagctccatgtggacccactccttcctgaggcctccgtctccccgtccgtgagacgctgtctacagcccctgcacgtacctccgtgaacttgtcggccaccatgtaacggacgcgccaggacttgtcctcagcagcctggcgcagggtgggcatcaccagggcctccaggtcctcctggggcaggagctg

SEQ ID NO: 64892 - DNA, 600 bp, Bovine  MMBT03692
cttctcatgcaagtaagataaacagaaaatattgtctgaagttactaatccaggtttcattgaataccttgtttaggtagagcagaaagtatgaagaaaaaaagacaagtgtaatggtcatactcaattctagtgtttctaatgactgagtcaaatatgtaacaatttatttgtgtgtttgtaatatttttaaaagttcattctgatgacctttcaatattcttaaatttatcaagtctaagagacaagaagtaaaggtgattgttagactaataattctcttatctataaaaaggattrtttccatgagttcattctcatcttttaagaaatggaatatattttgaagtgtttaaagtaactattccttcaagatcacccaaatctactcctaatcacaatttaattaattttagctaacacatgactggaggtgtaggtacttagattattcaagtctccacagtcagccatgttttccagtggctgctgatcatgacatcaggccctggtaagacctccattttggccattttcattattgatgtaggttacatcagactaacagtggctgaatatcagctgttaggctggcgaaga

SEQ ID NO: 64893 - DNA, 600 bp, Bovine   MMBT01127
gggttaaatgagagattggagacagctttgtagcctattgaaacaaagtatgccctcaacaaacagttactgattgattggtcaagtctatcagacactggatacatttaaagcacatgataaaaaatgtacagttttctgaatttgttataagttctgctgaatctgtcacatttgataaattggtcataaatgactattatctgtgaacatttgtatgaattcaccatgttttttatttagctctgtaaaaagaatattataatgctaactgccagtaactattagttgaagaatacmtcctttgagcagttcagtgcttggcatgtggtagagcagcacttagtaagtgtttgttgagtcaaagaacaaattattaacaacttctaatcaaggcctttgattcttcagcaattaaatctctttattctcattttttactttatggagaaatgctgaccaatatgatttaagtcacatacataattttatgtttttcagtatccacgtttgaaaaagtaaaaagaaacagctgaaattaattttaataatgtattttatttaasccatgtcaatatattatggttttgatatataatc

SEQ ID NO: 64894 - DNA, 600 bp, Bovine  MMBT14000
aactgtcctgggttagggaatccctgagcaatagtcaattaggaacagagcgctcgcctctaagtttagtactgagtcatctgcagaccctgctaaagacgtgaaaagataaagagggtaggagaggaaggagggagggagaggaagggagagacagagggaaacagggacagacacagagaaatatccctggtcaccatcaacagttacggaacttcccacagtcccactccctccaccgatgctcactgctcagggctgccctgagggtcacgtgccccgtttaaagcggaggaytgrggcttgcagaggtgccccggatcagcccggccgccgccagcgcccckcaagrgggggcccggatacgcccgcgaccccggacgaaagaagcctgcccgccccccgggcccgcacacctcctccttccgcgagcgcttggacactttcttctccatcttagcggccgtcttctccgccccgcggcccttcttctctttcttgccctttttgcccatcgcgccggatccaaggaggcttctgarccgcctgtgagactctagcggcgcgccgcgcgcggcgcgcaggaaatacgtgctgggg

SEQ ID NO: 64895 - DNA, 600 bp, Bovine  MMBT21665
tctttttgcatttattcttttcttcccttttaaaaaataactttatttatttacttatttttgtctgctaggtctgcattgctgctcaggcttttccccagttgtggcaagtgagggctgttctctggtttcagggtgggcttctcactgccgtggcttctcactgcagtggcttctcgtgtggagtatgggccgtagggcacatgggctttggtagttacaccctggggctctagagcacaygctcaatatttgtggcaaatggcatacgggatcttstcagatcagggatcaaacccrtgtctcatcaccacagtaagcctaacatccatccgcatacatggttgcaatyattttttcctagtgatgagaacttttaagatctattctcttggcacggcattcttaaagtgcttattttttccacttaaaaaaaatccaagttggaagcagcatgttatattaagagattctgcatgtaatatgggcatcttaaatttaccatgaaactgaattttttgccttagagatgcagaagctagaataatggatattataattcatgctcagtgatgcttcagacaacaaatgtgacctgtt

SEQ ID NO: 64896 - DNA, 24 bp, Artificial sequence
  Primer
taaatggacctttgctaagttttg

SEQ ID NO: 64897 - DNA, 21 bp, Artificial sequence
  Primer
ttctacttcccccctctaatc

SEQ ID NO: 64898 - DNA, 21 bp, Artificial sequence
  Primer
atggggtcattcacttgactc

SEQ ID NO: 64899 - DNA, 18 bp, Artificial sequence
  Primer
actgcacatagcggccat

SEQ ID NO: 64900 - DNA, 18 bp, Artificial sequence
  Primer
ttctcccccacagaacct

SEQ ID NO: 64901 - DNA, 28 bp, Artificial sequence
  Primer
acaagaagtaaaggtgattgttagacta

SEQ ID NO: 64902 - DNA, 32 bp, Artificial sequence
  Primer
tagctctgtaaaaagaatattataatgctaac

SEQ ID NO: 64903 - DNA, 18 bp, Artificial sequence
  Primer
accgatgctcactgctca

SEQ ID NO: 64904 - DNA, 18 bp, Artificial sequence
  Primer
tgtggcaaatggcatacg

SEQ ID NO: 64905 - DNA, 18 bp, Artificial sequence
  Primer
agaaccacttgggggtgg

SEQ ID NO: 64906 - DNA, 26 bp, Artificial sequence
  Primer
aaaaaagtctttaaaaaagatacggg

SEQ ID NO: 64907 - DNA, 21 bp, Artificial sequence
  Primer
acacaccaaatcagaggtgaa

SEQ ID NO: 64908 - DNA, 25 bp, Artificial sequence
  Primer
tcagtaccagtgactgtaatcatga

SEQ ID NO: 64909 - DNA, 23 bp, Artificial sequence
  Primer
atttgattagctcacctgtcaac

SEQ ID NO: 64910 - DNA, 30 bp, Artificial sequence
  Primer
atcttgaaggaatagttactttaaacactt

SEQ ID NO: 64911 - DNA, 21 bp, Artificial sequence
  Primer
taagtgctgctctaccacatg

SEQ ID NO: 64912 - DNA, 18 bp, Artificial sequence
  Primer
ttctttcgtccggggtcg

SEQ ID NO: 64913 - DNA, 19 bp, Artificial sequence
  Primer
catgtatgcggatggatgt

SEQ ID NO: 64914 - DNA, 45 bp, Artificial sequence
  Primer
ggatggcgttccgtcctatttaccccactctctgctgttgtcatg

SEQ ID NO: 64915 - DNA, 45 bp, Artificial sequence
  Primer
acgcacgtccacggtgatttgaaaagaaacccttaggtttggggc

SEQ ID NO: 64916 - DNA, 45 bp, Artificial sequence
  Primer
agatagagtcgatgccagctttcaggcctgtgaccacaggctctt

SEQ ID NO: 64917 - DNA, 45 bp, Artificial sequence
  Primer
agggtctctacgctgacgatctaattactattacttaataaaaaa

SEQ ID NO: 64918 - DNA, 45 bp, Artificial sequence
  Primer
agggtctctacgctgacgatagttggcctcagaaacctcaaggaa

SEQ ID NO: 64919 - DNA, 45 bp, Artificial sequence
  Primer
cgtgccgctcgtgatagaataattctcttatctataaaaaggatt

SEQ ID NO: 64920 - DNA, 45 bp, Artificial sequence
  Primer
gcggtaggttcccgacatatccagtaactattagttgaagaatac

SEQ ID NO: 64921 - DNA, 45 bp, Artificial sequence
  Primer
ggatggcgttccgtcctattgtgccccgtttaaagcggaggaytg

SEQ ID NO: 64922 - DNA, 45 bp, Artificial sequence
  Primer
agagcgagtgacgcatactattaggcttactgtggtgatgagaca
